United States Patent 11,723,967 (ZIKA VIRUS VACCINE) - sequence listing, part 9

SEQ ID NO: 10953 - RNA, 2017 nt, Artificial Sequence
  ZIKV (strain ZikaSPH2015) ME variant mRNA Design 3 opt
gggagaaagcuuaccauggacuggacauggauacuauuccucguagcagcagcgacaagagugcacagugcaguaacccuccccucacacagcacgagaaaacuacagacgcgcagccaaaccuggcucgaaucacgagaauacaccaaacaccuaauacgagucgagaacuggauauucagaaaccccggcuucgcccuagcagcagcagcaaucgccuggcuccuaggcagcagcacaucacaaaaagugauauaccugguaaugauccuucuuauagcccccgccuauaguauaagaugcaucggcgucagcaaucgcgacuucgucgaaggaaugucgggaggaaccugggucgacauaguucuagagcacggaggcugcgucaccguaauggcacaagacaaaccaacaguggacaucgaauuaguuaccacaacgguaagcaacauggccgaagucagaagcuauugcuacgaagcaagcauaucagacauggcaagcgacucccgaugccccacccaaggcgaggcuuaccuagacaaacagagugacacccaguacgugugcaaaagaacccuagucgaccguggcuggggcaacggaugcggacucuucggcaaagggagccucguaacaugcgcaaaauucgcuugcucaaagaaaaugaccggcaaaagcauccaaccagaaaaccuagaauaccgaaucaugcucuccguacacggaucacaacacagcggaaugauagugaacgacaccgggcacgagacagacgagaaccgcgccaaaguagaaauaacccccaacagucccagagccgaagcgacacuaggaggauucggaucauuagggcuggacugcgagccacgaaccggccuagacuucucagaccuauacuaccucacgaugaacaacaaacacuggcucguacacaaggaaugguuccacgacauaccccuaccauggcacgccggcgcagacacaggcacaccccacuggaacaauaaagaagcccucgucgaauuuaaagacgcccacgccaaacgccaaacaguggugguacucggcucacaagaaggugccguucacacggcccuagcaggcgcccuggaagccgaaauggacggagccaaaggucgacuaagcagcggacaucuaaaaugcagacugaaaauggacaaacuccggcucaaaggaguaucauacagccuaugcaccgccgccuucacguucacaaaaauaccagcagagacccuccacggcacagucacgguagaaguccaauacgccggcaccgacggccccugcaaagugccagcacaaauggcagucgacaugcaaacccugacacccgucggcaggcuaaucaccgcaaaccccgucaucacagagaguacagagaacagcaaaaugaugcucgaacucgacccacccuucggagacucguacaucgucauaggcgucggcgaaaagaaaaucacccaucacuggcauagaagcggaagcaccauaggcaaagccuucgaagccaccguacgcggggccaaacgcauggccguccucggagacacagcgugggacuucggcucgguaggcggcgcacucaacucacucggcaaaggcauacaccaaaucuucggcgcagccuucaaaucccuauucggcgggaugagcugguucucgcaaauacuaauaggcacccugcuaauguggcucggacuaaacaccaaaaacggcucgaucucauuaaugugccuagcgcucggcggaguacuaaucuuccuaucaacagcaguaucagccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10954 - RNA, 2017 nt, Artificial Sequence
  ZIKV (isolate Z1106033) ME variant mRNA Design 3 opt
gggagaaagcuuaccauggacuggaccuggauccucuuccucguagccgccgccacacgcguacacagcgcagucacacucccgagccacagcaccagaaaguuacaaacacgcucucaaacguggcuagagucccgagaauacacaaaacaccuaauacgcguagaaaacuggaucuucagaaacccagguuucgcccuggcggcagccgccaucgcguggcuacucggcucaagcaccagccaaaaagucaucuaccucgucaugauccuacucauagccccagccuacuccauccgaugcaucggagucuccaauagagacuucguggagggaaugagcggcgguaccugggucgacguuguccuagaacacggcggcugcgucaccguuauggcccaagacaaacccaccgucgacauagaauuagucaccacaacagucucaaacauggccgaaguccgaagcuacuguuacgaagccuccaucuccgacauggccagcgacucacggugcccgacccaaggcgaggcuuaccucgacaaacaaucagacacacaauacgucugcaaacgcacacucgucgacagaggcuggggcaacggcugcggccuguucggcaaaggcucccuaguuaccugcgcuaaauucgcaugcagcaagaaaaugaccggcaaaagcauccagcccgaaaaccuagaauacagaaucaugcucucaguccacggaagccaacacagcggcaugauagucaacgacaccggccacgaaaccgacgaaaacagagccaaagucgaaaucacccccaacucaccccgcgcggaggccacacuuggcggauucggcucccuaggacuggacugcgaaccccgcaccgggcuagacuucuccgaccuauacuaccucacaaugaacaacaaacacuggcuaguccacaaagaaugguuccacgacauaccauuacccuggcaugccggcgcagacacaggaacaccccacuggaacaacaaagaagcacucgucgaguucaaagacgcccacgccaaacgccaaaccgucgucgugcuaggaucccaagaaggugccguacacaccgcccuugcaggggcucucgaagccgaaauggacggcgccaagggacgccuuuccuccggccaccugaaaugccggcucaaaauggacaaauuacgacucaaggguguaucauacucccucugcaccgcagcauucaccuucaccaaaauccccgccgaaacgcuccauggcaccgucacagucgaaguucaauacgccggcaccgacggacccugcaaggugccggcgcaaauggccgucgacaugcaaacccuaacgcccguagggaggcucaucacugccaacccaguaauaacagaaagcacagaaaacuccaaaaugaugcucgaacucgacccgcccuucggggacucauacauaguaauuggcguaggcgaaaagaaaauaacacaccacuggcacagaagcggaucaacaauaggaaaagccuucgaagcaacgguaagaggggccaaaagaauggccguacucggagacaccgccugggacuucggcucaguugggggugcacuaaacucccucggcaaagguauccaccaaauauucggcgcugcauucaaaucacucuucggaggaaugucaugguucucccagauacucauaggcacccugcucauguggcucggccucaacgcgaaaaacgguagcauuucacuaaugugccucgcauuaggcggagugcucauauuccuaucaaccgcagucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10955 - RNA, 2005 nt, Artificial Sequence
  ZIKV (strain MR 766) ME variant mRNA Design 3 opt
gggagaaagcuuaccauggauuggaccuggauacucuuccuagucgcagcagcaaccagaguacacucagccguuacccuccccagccacucaacaagaaagcugcaaacacgcagccaaacguggcuagaaucccgcgaauacacgaaacaccucauaaaggucgaaaacuggaucuucagaaacccaggcuucgcgcucgucgcggucgccaucgcauggcuacucggguccagcacuucccaaaaagucauauaccuagucaugauccuacucaucgcacccgcuuacagcauccgcugcaucggaguauccaaucgagacuucguagaaggcaugagcggaggcacauggguagacguaguccucgaacacggcggaugcgucaccguaauggcgcaagacaaacccaccguagacaucgaacucguaacaacaaccgucucgaacauggcagaagucagaagcuacugcuacgaagcaagcauaagcgacauggcgagcgacucccgcugccccacccaaggggaagccuaccuggacaaacaaagcgacacccaauacguaugcaaacgaacacucguagauagaggcuggggcaacggaugcggccuauucggaaagggaucccuagucacaugcgcaaaauucacaugcucaaagaaaaugacaggcaaaucaauacaacccgaaaaccucgaauaccgcaucaugcucagcguccacggaucacaacacucgggaaugauaggauacgaaacggacgaagaccgggcaaaaguagaggucacaccaaacuccccaagggcggaagccacccucggcgguuucggcucacuggggcuagacugcgaaccccgcaccggacucgauuucucagaccuauacuaccucacaaugaacaacaaacacuggcucgugcacaaggaaugguuccacgacauaccccucccguggcacgccggcgcggacacaggaacaccccacuggaacaauaaagaagcacucgucgaguucaaagacgcacacgccaaacgccagaccguaguaguacucggaucacaagaaggggccguacacacggcgcuggccggagcacuagaagcagaaauggauggcgcaaaaggccggcuauucaguggacaccuaaaaugucgccuaaaaauggacaaacucagacucaaaggagucuccuacucccuaugcacggccgcguucacauucacaaaaguccccgcagaaacacuccacggcacgguuacagucgaaguccaauacgcaggcaccgacggccccuguaaaauaccuguacaaauggccgucgacaugcaaacacucacacccgucggaagacugaucacugcaaacccagucauaacagaaaguacagaaaacagcaaaaugaugcuagaacuugacccacccuucggcgauucguacaucgucaucggcguaggagacaagaaaaucacccaccacuggcaccgaagcggcagcaccauaggaaaagcauucgaagcaacaguacgcggagccaaaagaauggccguccuuggagacacagccugggacuucggguccgucggaggcguauucaacagccugggaaaaggcauccaccagaucuucggcgcagcauucaaaucgcuauucgguggaauguccugguucagccaaauccuaaucgggacccucuuaguguggcuaggacuaaacacgaaaaacggcagcaucagccuaaccugccuagcccugggaggggucaugaucuuccucucaacugcagucucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10956 - RNA, 2017 nt, Artificial Sequence
  ZIKV (strain NatalRGN) ME variant mRNA Design 3 opt
gggagaaagcuuaccauggacuggacguggauacucuuccucguagcagcggccacaagaguccacagcgcaguaacacugcccucacacucuacccgcaaacugcaaacacgcagccaaacauggcuagaaucacgcgaguacacaaaacaccugauccgagucgaaaacuggauauucagaaacccaggauucgcccuggcagcggccgccauagccuggcuacucggaagcucuaccucacaaaagguaauauaccuaguaaugauccuccucaucgcccccgccuacucaauacgcugcaucggaguaagcaaccgcgacuucgucgaaggaaugagcggaggaaccuggguggacgucgucuuagagcacggaggaugugucacgguaauggcccaagacaaacccaccgucgacauagaguuggucaccacaacagucuccaacauggccgaggucagaagcuacuguuacgaagcaaguaucucagacauggccagcgacagccgcugcccaacacaaggagaagcauaccucgacaagcaaagugacacacaauacgugugcaagcgcacgcuaguagaccgaggcuggggaaacggcugcggccucuucggaaaaggcagccucguaacaugcgccaaauucgccugcuccaaaaagaugaccggcaagucgauccaacccgaaaaccucgaauacagaaucaugcuauccguacacggaagccaacacucaggcaugauagucaacgacacuggacacgaaaccgacgaaaaccgcgccaaaguagaaaucacaccaaacucaccacgagcagaagcaaccuuaggaggauucggcucccuaggacucgauugcgagcccagaacagggcuggacuucucagaccuauacuaccuaacaaugaacaacaaacacuggcuaguacacaaagaaugguuucacgacauaccacuaccauggcacgcuggugcagacacgggaacgccccacuggaacaacaaagaagcacucguagaguucaaagacgcacacgcaaagagacaaacaguugucguccuaggaagccaagaaggcgccguacacacggcccucgccggagcucucgaagccgaaauggacggagcuaagggaagacucagcagcggccaccuaaaaugccgacuaaaaauggacaaacuccgacucaagggaguaagcuacucacuaugcacggccgccuucacauucacaaaaauacccgccgagacccuccacggaaccgucaccgucgagguacaguacgcaggaaccgacggacccugcaaaguacccgcgcagauggcaguagacaugcaaacacucacccccgugggacgccucauaaccgcgaacccagucauaaccgaguccacggaaaacagcaaaaugaugcuagaacuugacccaccauucggagacuccuacaucguaauaggcgucggcgaaaagaaaaucacacaccacuggcaccgaucaggcucgaccaucggaaaagccuucgaagcaacaguacgcggcgccaaacgcauggcaguccucggagacacggccugggacuucggcucaguagggggcgcacucaacagucuaggaaaaggcauacaccagaucuuuggggcagccuucaaaagccuauucggcggaaugagcugguucagccaaaucuuaaucggaacacuacuaauguggcucggccuaaacaccaaaaacggauccaucagccuuaugugccuugccuuaggaggcgugcuaauauuccugagcacagcuguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10957 - RNA, 2035 nt, Artificial Sequence
  ZIKV (strain ZikaSPH2015) ME variant mRNA Design 3 opt
gggagaaagcuuaccauggguaaaagauccgccggcagcauaauguggcuggccucccucgccgucgugauagcaugcgcaggcgccgcagucacacuccccagccacagcaccagaaaacuacaaacccgcucccaaaccuggcuagaaucaagagaauauacaaaacaccucauaagagucgaaaacuggauauuccgaaaccccggcuucgcacucgccgccgcagcaauagccuggcuccucggcucuagcacgucacaaaaggucauauaucuagucaugaucuugcuaaucgccccagcauacuccauccggugcauaggcguuuccaaucgggacuucguagaaggcauguccggcggaaccugggucgauauaguccuagaacauggcggaugcgucacagucauggcacaagacaaacccaccguagacauagagcuagucaccacgaccgugagcaacauggccgaagucagaucauacugcuacgaagcaucaaucucggacauggcauccgacagccgcugucccacacagggagaagccuaccuagacaaacaauccgacacacaauacgucugcaaacgaacccuaguagaccgcgguuggggaaacggaugcggccucuucggcaaaggaagccuggucacaugcgcaaaauucgccugcagcaagaagaugaccggcaaaagcauccaaccugaaaaccucgaauaccgcaucaugcuuuccguacacggcagucaacacuccggaaugaucgucaacgacacagggcacgaaaccgacgaaaaccgcgccaaagucgaaaucacacccaacagcccccgagccgaagccacccucggcggcuucggcucccucggacuagacugcgagcccaggacgggccucgacuucuccgaccuauacuaccucacaaugaacaacaaacacuggcuaguccacaaagaaugguuccacgacaucccccuccccuggcacgcaggcgccgacacaggcacaccacacuggaacaacaaggaagcacucguagaguucaaagacgcccacgcaaaacgccaaacaguaguaguacugggaucccaagaaggagccgugcacaccgcacuagcaggcgcacucgaagccgaaauggacggagcgaagggccgacuaucguccggacaccuuaaaugcaggcugaagauggacaaacucagacuaaaaggaguauccuacucccuaugcacagccgcauucacauucaccaaaauacccgcagaaacccuacacggaaccgucacagucgaaguccaauacgccggaaccgacggccccugcaaaguccccgcgcaaauggccguagacaugcaaacucucacccccguuggaagacucaucaccgccaacccggucaucacggaaaguaccgaaaacuccaaaaugaugcucgagcuagacccacccuucggagauuccuacauagucaucggcguaggagaaaagaaaauaacacaucacuggcacagauccggcuccaccauaggcaaagccuucgaagccaccguacgcggggcuaaacgcauggccguccucggcgacacagcaugggacuucggauccguaggcggagcccucaacucacugggcaaagggauucaccaaaucuucggcgccgccuucaaaagccuauucggcggaaugagcugguucucccaaauccuaauuggcacccuacuaauguggcucggccucaacacgaaaaacggcagcaucagccuuaugugcuuagcccucggaggcguccucaucuuccucuccacagccgucuccgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10958 - RNA, 2035 nt, Artificial Sequence
  ZIKV (isolate Z1106033) ME variant mRNA Design 3 opt
gggagaaagcuuaccauggggaaacgaagcgcaggcuccaucauguggcucgccucacuagcagucgucauagcaugcgcaggcgcagccguaacccucccuucccacucaacaagaaaacuacaaaccagaucacaaacguggcuagaaucgcgagaauacacgaaacaccucaucagagucgaaaacuggauauuuaggaaccccggcuucgcccuagcagcagccgcaaucgcguggcugcugggcagcucaacaucgcaaaaagugauauaccuaguaaugauccuccuaauagccccggcauacagcauacgcugcaucggaguaucaaaccgagacuuugucgaggguauguccggcggaacauggguagacgugguucucgaacacggcggcugcguaaccguaauggcacaagacaaaccaaccguggacaucgaacucgucacaacaaccguaagcaacauggccgagguacgauccuacugcuacgaagccagcauuucagacauggcaagcgacuccagaugcccaacccagggcgaagccuaccucgacaaacaaagcgacacacaauacguaugcaaacgaacacucguggaccgaggcuggggaaacggcugcggacuguucggaaaaggaagccuagugaccugcgcgaaauucgccugcuccaagaaaaugacaggaaaaucaauccagccugaaaaccucgaguaccgaauaaugcucagcguccauggaagccagcacuccggcaugauaguaaacgacacaggacacgaaacggacgaaaacagagcaaaaguagaaaucaccccaaacucacccagagccgaagcaacacuuggaggcuucggcucacucggacuagacugcgagccacgcaccggacucgacuucagcgaccucuacuaccuaaccaugaacaacaaacacuggcuuguacacaaagaaugguuccacgacauaccccucccuuggcacgcaggagcagacaccggaacaccccacuggaacaacaaagaagcacugguagaguucaaagacgcacacgcaaaacgacaaaccguagucgugcugggcagucaagaaggcgccgugcacaccgcccucgcuggagcccuugaagcagaaauggacggggccaaaggcagacucucauccggccaccucaaaugccgacucaaaauggacaaacuuagacuaaaaggcguaagcuacagccugugcacggcggcauucacauucacgaaaauaccagccgagacccuacacggcacugucaccguagaaguacaguacgcaggcacagacgggcccugcaaaguacccgcacaaauggccguugacaugcaaacccuaaccccagucggccgccucaucaccgccaaccccguaauaacagaaagcacagaaaacagcaaaaugaugcucgaacucgacccaccguucggagacagcuacaucguaaucggcgugggcgaaaagaaaauaacgcaucacuggcaccgaucaggaucaaccaucggcaaagccuucgaagcaaccguucgcggcgcaaaaagaauggccguacuaggcgacacggcaugggauuucgguagcguagggggcgcccuaaacucccuaggcaaaggcauccaccaaaucuucggcgccgcauucaaaucacuauucggcggaaugagcugguucagccaaauccucaucggcacccuccucaugugguuaggacugaaugccaaaaacggaagcaucucacucaugugccuagcccugggaggaguauuaaucuuccuaucuacagcaguaucggccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10959 - RNA, 2023 nt, Artificial Sequence
  ZIKV (strain MR 766) ME variant mRNA Design 3 opt
gggagaaagcuuaccaugggcaaaagaucagccggaucaaucauguggcuugcaagccucgcuguaguaaucgccugcgcuggagcagcagucacccuccccucacacuccaccagaaaacuacaaacacgcucccaaacauggcucgaaucacgagaauacaccaaacaccucaucaaggucgaaaacuggaucuuccgaaaccccggauucgcacucguagcaguagccaucgcauggcuacucggauccucaaccagccagaaaguaauauaccuagucaugauccuccugauagcacccgccuacagcauccgaugcaucggcgucagcaaccgagacuucgucgaaggcaugucagggggaaccugggucgacgucguccuagagcacggcggcugcguaacagucauggcacaagacaagcccaccgucgacauagaacuggucacaacuaccguauccaacauggccgagguaagauccuacugcuacgaagccagcauaagcgacauggccagcgacaguaggugcccuacacaaggcgaagccuaccucgauaaacaaucagacacccaauaugucuguaaacgcacucuaguagacagaggauggggcaacggcugcggccuauuuggcaaaggcagccuagucacaugcgcaaaguuuaccugcagcaagaaaaugaccggaaaaucaauccaaccagaaaaccucgaauaccgaaucaugcucucaguacacggaucgcaacacucaggcaugaucggcuaugaaaccgacgaagaccgugccaaaguagaaguaaccccaaacagcccacgagcugaagcaacccuaggaggcuucggaucccucgggcucgacugcgaaccaagaaccggccuagacuucuccgaccuguacuaccucacgaugaacaacaaacacuggcucguacacaaggaaugguuccacgacauaccgcuacccuggcacgcaggcgcagacacaggcacgccacacuggaacaacaaagaagcccuaguggaguucaaagacgcacacgcaaaacgccagaccguggucguccuagggagccaagaaggagccguacacacagcccuggccggcgcccuugaagccgaaauggacggcgcaaaaggccgacucuucagcggacaccucaaaugccgucucaaaauggacaaacuacggcucaaaggcguauccuauucacucugcaccgccgccuucacauucacaaaggucccugcggaaacucuacacggaacagucacagucgaagugcaauacgcaggaaccgacggcccuugcaagauaccaguccagauggccgucgacaugcaaacccucacgccagucggccgacucaucaccgcaaaccccguaaucacagaaucaacggaaaacucaaagaugaugcucgagcucgacccucccuucggagacucauacauagucaucggggucggcgacaagaaaauaacccaccacuggcacagaagcggcuccaccaucggaaaagccuucgaagcgacaguccgaggcgcaaaacgcauggccguacucggagacaccgcgugggacuuuggcucaguaggcggcguguuuaacagccucggaaaaggaauccaccaaauauucggagcagcguucaaaucacuguucggcgggauguccugguucucccaaauccucaucggaacacuucucguauggcuaggccuaaacaccaaaaacggaucaaucucacuaacaugccucgcccucggaggagucaugauauuccugucgacugcggucucggccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10960 - RNA, 2035 nt, Artificial Sequence
  ZIKV (strain NatalRGN) ME variant mRNA Design 3 opt
gggagaaagcuuaccaugggaaagcgauccgcaggauccauaauguggcucgccucccuagccgucguaauagcgugcgccggcgcagccguaacccuacccucccacagcacccgcaagcuacaaacacgcucacaaaccuggcuugaaucacgcgaguacacuaaacaccuaauacgcguagaaaacuggaucuuccguaaccccggguucgcacucgccgcagccgccaucgccuggcuucuaggaagcuccacaucacaaaaagucaucuaccuagucaugauccuccucauugccccagccuacaguaucagaugcaucggugucuccaaccgggacuucgucgaagggauguccggaggaacauggguagacgucguccucgaacacggcggcugcguaaccguaauggcgcaggacaaaccgacugucgacauagagcuaguaaccacuaccgucuccaacauggcagaaguacgauccuacugcuacgaagccagcauuagcgacauggcauccgacagccgcugccccacccaaggcgaagccuaccucgacaaacaaucagacacccaauacgucugcaaacgcacacucgucgaccguggcuggggcaacggcugcggacucuucggaaagggcucccuaguuaccugcgcaaaguucgccuguuccaagaaaaugaccggcaaaucgauacaaccagaaaaccucgaauaucgaauaaugcucuccguccacggcagccaacacagcggcaugauaguaaacgacaccggacacgaaacagacgaaaaccgcgcuaaagucgaaauaacacccaacucaccccgggccgaagccacccucggcggcuucggaucacucggccucgacugcgagcccagaaccggccuagacuucucggaccucuacuaucuaacaaugaacaacaaacacuggcucguccacaaagaaugguuccacgacaucccacuccccuggcacgccggagccgacaccggaacaccucacuggaacaacaaagaagcccucgucgaguucaaagacgcccacgccaaacgccagacagugguaguacuaggcagccaagaaggagccguccacacggcccuagcaggagcccuggaagccgaaauggacggagcaaaaggcagacucucuagcggccaccucaagugccgccuaaaaauggacaaacuacgacuaaaaggcguuuccuacagccugugcaccgccgccuucacguucacuaaaauacccgccgaaacccuccacggcaccguaacagucgaaguccaauacgcaggaaccgacggaccgugcaaaguaccugcacaaauggccguagacaugcagacccugaccccaguaggcagacuaaucacagccaaccccguaauaacggaaucaaccgaaaacucaaaaaugaugcuugaacuagacccgcccuucggggacaguuacaucguaaucggcgucggagaaaagaaaauaacccaccacuggcacagauccggaucaaccaucggaaaggccuucgaagcaaccguccggggagccaaacgcauggccguccuaggagacacagccugggacuucggcagugucggcggcgcccucaacagucugggaaaaggcauacaccaaaucuucggcgcagcauucaagagccuauucgggggaaugagcugguucucccaaauacuaauaggaacccuccuaauguggcugggacucaacaccaaaaacggcagcaucucacucaugugccucgcccucggcggaguacugauauuccucucuacagcagucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10961 - protein, 30 aa, Artificial Sequence
  signal peptide - YFV
MRGLSSRKRRSHDVLTVQFLILGMLLMTGG

SEQ ID NO: 10962 - protein, 25 aa, Artificial Sequence
  signal peptide - MHCII
MAISGVPVLGFFIIAVLMSAQESWA

SEQ ID NO: 10963 - protein, 18 aa, Artificial Sequence
  signal peptide - IgE
MDWTWILFLVAAATRVHS

SEQ ID NO: 10964 - protein, 24 aa, Artificial Sequence
  signal peptide - JEV
MGKRSAGSIMWLASLAVVIACAGA

SEQ ID NO: 10965 - protein, 101 aa, Artificial Sequence
  Cterm
GSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 10966 - protein, 30 aa, Artificial Sequence
  signal peptide - JEV
MGRKQNKRGGNEGSIMWLASLAVVIACAGA

SEQ ID NO: 10967 - protein, 21 aa, Artificial Sequence
  signal peptide - JEV
MNEGSIMWLASLAVVIACAGA

SEQ ID NO: 10968 - protein, 700 aa, Artificial Sequence
  ZIKV (strain ZikaSPH2015) prME-short variant
MGRKQNKRGGNEGSIMWLASLAVVIACAGAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 10969 - protein, 700 aa, Artificial Sequence
  ZIKV (isolate Z1106033) prME-short variant
MGRKQNKRGGNEGSIMWLASLAVVIACAGAVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSA

SEQ ID NO: 10970 - protein, 696 aa, Artificial Sequence
  ZIKV (strain MR 766) prME-short variant
MGRKQNKRGGNEGSIMWLASLAVVIACAGAITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 10971 - protein, 700 aa, Artificial Sequence
  ZIKV (strain NatalRGN) prME-short variant
MGRKQNKRGGNEGSIMWLASLAVVIACAGAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 10972 - protein, 691 aa, Artificial Sequence
  ZIKV (strain ZikaSPH2015) prME-short variant
MNEGSIMWLASLAVVIACAGAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 10973 - protein, 691 aa, Artificial Sequence
  ZIKV (isolate Z1106033) prME-short variant
MNEGSIMWLASLAVVIACAGAVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSA

SEQ ID NO: 10974 - protein, 687 aa, Artificial Sequence
  ZIKV (strain MR 766) prME-short variant
MNEGSIMWLASLAVVIACAGAITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 10975 - protein, 691 aa, Artificial Sequence
  ZIKV (strain NatalRGN) prME-short variant
MNEGSIMWLASLAVVIACAGAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 10976 - protein, 700 aa, Artificial Sequence
  ZIKV (strain ZikaSPH2015) prME-short variant
MGRKQNKRGGNEGSIMWLASLAVVIACAGAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 10977 - protein, 700 aa, Artificial Sequence
  ZIKV (isolate Z1106033) prME-short variant
MGRKQNKRGGNEGSIMWLASLAVVIACAGAVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 10978 - protein, 696 aa, Artificial Sequence
  ZIKV (strain MR 766) prME-short variant
MGRKQNKRGGNEGSIMWLASLAVVIACAGAITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 10979 - protein, 700 aa, Artificial Sequence
  ZIKV (strain NatalRGN) prME-short variant
MGRKQNKRGGNEGSIMWLASLAVVIACAGAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 10980 - protein, 691 aa, Artificial Sequence
  ZIKV (strain ZikaSPH2015) prME-short variant
MNEGSIMWLASLAVVIACAGAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 10981 - protein, 691 aa, Artificial Sequence
  ZIKV (isolate Z1106033) prME-short variant
MNEGSIMWLASLAVVIACAGAVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 10982 - protein, 687 aa, Artificial Sequence
  ZIKV (strain MR 766) prME-short variant
MNEGSIMWLASLAVVIACAGAITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 10983 - protein, 691 aa, Artificial Sequence
  ZIKV (strain NatalRGN) prME-short variant
MNEGSIMWLASLAVVIACAGAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 10984 - protein, 700 aa, Artificial Sequence; identical to SEQ ID NO: 10968
  ZIKV (strain ZikaSPH2015) ME variant

SEQ ID NO: 10985 - protein, 700 aa, Artificial Sequence; identical to SEQ ID NO: 10969
  ZIKV (isolate Z1106033) ME variant

SEQ ID NO: 10986 - protein, 696 aa, Artificial Sequence; identical to SEQ ID NO: 10970
  ZIKV (strain MR 766) ME variant

SEQ ID NO: 10987 - protein, 700 aa, Artificial Sequence; identical to SEQ ID NO: 10971
  ZIKV (strain NatalRGN) ME variant

SEQ ID NO: 10988 - protein, 691 aa, Artificial Sequence; identical to SEQ ID NO: 10972
  ZIKV (strain ZikaSPH2015) ME variant

SEQ ID NO: 10989 - protein, 691 aa, Artificial Sequence; identical to SEQ ID NO: 10973
  ZIKV (isolate Z1106033) ME variant

SEQ ID NO: 10990 - protein, 687 aa, Artificial Sequence; identical to SEQ ID NO: 10974
  ZIKV (strain MR 766) ME variant

SEQ ID NO: 10991 - protein, 691 aa, Artificial Sequence; identical to SEQ ID NO: 10975
  ZIKV (strain NatalRGN) ME variant

SEQ ID NO: 10992 - RNA, 2100 nt, Artificial Sequence
  ZIKV (strain ZikaSPH2015) prME-short variant CDS wild type
augggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 10993 - RNA, 2100 nt, Artificial Sequence
  ZIKV (isolate Z1106033) prME-short variant CDS wild type
augggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcu

SEQ ID NO: 10994 - RNA, 2088 nt, Artificial Sequence
  ZIKV (strain MR 766) prME-short variant CDS wild type
augggcagaaagcaaaacaaaagaggaggaaaugaaggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 10995 - RNA, 2100 nt, Artificial Sequence
  ZIKV (strain NatalRGN) prME-short variant CDS wild type
augggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcu

SEQ ID NO: 10996 - RNA, 2073 nt, Artificial Sequence
  ZIKV (strain ZikaSPH2015) prME-short variant CDS wild type
augaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 10997 - RNA, 2073 nt, Artificial Sequence
  ZIKV (isolate Z1106033) prME-short variant CDS wild type
augaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcu

SEQ ID NO: 10998 - RNA, 2061 nt, Artificial Sequence
  ZIKV (strain MR 766) prME-short variant CDS wild type
augaaugaaggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 10999 - RNA, 2073 nt, Artificial Sequence
  ZIKV (strain NatalRGN) prME-short variant CDS wild type
augaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcu

SEQ ID NO: 11000 - RNA, 2100 nt, Artificial Sequence
  ZIKV (strain ZikaSPH2015) prME-short variant CDS wild type
augggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 11001 - RNA, 2100 nt, Artificial Sequence
  ZIKV (isolate Z1106033) prME-short variant CDS wild type
augggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 11002 - RNA, 2088 nt, Artificial Sequence
  ZIKV (strain MR 766) prME-short variant CDS wild type
augggcagaaagcaaaacaaaagaggaggaaaugaaggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 11003 - RNA, 2100 nt, Artificial Sequence
  ZIKV (strain NatalRGN) prME-short variant CDS wild type
augggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 11004 - RNA, 2073 nt, Artificial Sequence
  ZIKV (strain ZikaSPH2015) prME-short variant CDS wild type
augaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 11005 - RNA, 2073 nt, Artificial Sequence
  ZIKV (isolate Z1106033) prME-short variant CDS wild type
augaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 11006 - RNA, 2061 nt, Artificial Sequence
  ZIKV (strain MR 766) prME-short variant CDS wild type
augaaugaaggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 11007 - RNA, 2073 nt, Artificial Sequence
  ZIKV (strain NatalRGN) prME-short variant CDS wild type
augaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 11008 - RNA, 2100 nt, Artificial Sequence; identical to SEQ ID NO: 10992
  ZIKV (strain ZikaSPH2015) ME variant CDS wild type

SEQ ID NO: 11009 - RNA, 2100 nt, Artificial Sequence; identical to SEQ ID NO: 10993
  ZIKV (isolate Z1106033) ME variant CDS wild type

SEQ ID NO: 11010 - RNA, 2088 nt, Artificial Sequence; identical to SEQ ID NO: 10994
  ZIKV (strain MR 766) ME variant CDS wild type

SEQ ID NO: 11011 - RNA, 2100 nt, Artificial Sequence; identical to SEQ ID NO: 10995
  ZIKV (strain NatalRGN) ME variant CDS wild type

SEQ ID NO: 11012 - RNA, 2073 nt, Artificial Sequence; identical to SEQ ID NO: 10996
  ZIKV (strain ZikaSPH2015) ME variant CDS wild type

SEQ ID NO: 11013 - RNA, 2073 nt, Artificial Sequence; identical to SEQ ID NO: 10997
  ZIKV (isolate Z1106033) ME variant CDS wild type

SEQ ID NO: 11014 - RNA, 2061 nt, Artificial Sequence; identical to SEQ ID NO: 10998
  ZIKV (strain MR 766) ME variant CDS wild type

SEQ ID NO: 11015 - RNA, 2073 nt, Artificial Sequence; identical to SEQ ID NO: 10999
  ZIKV (strain NatalRGN) ME variant CDS wild type

SEQ ID NO: 11016 - RNA, 2100 nt, Artificial Sequence
  ZIKV (strain ZikaSPH2015) prME-short variant CDS opt
augggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 11017 - RNA, 2100 nt, Artificial Sequence
  ZIKV (isolate Z1106033) prME-short variant CDS opt
augggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgcc

SEQ ID NO: 11018 - RNA, 2088 nt, Artificial Sequence
  ZIKV (strain MR 766) prME-short variant CDS opt
augggccggaagcagaacaagcgcgggggcaacgaggggagcaucauguggcuggccucccucgccguggucaucgcgugcgccggcgccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgcc

SEQ ID NO: 11019 - RNA, 2100 nt, Artificial Sequence
  ZIKV (strain NatalRGN) prME-short variant CDS opt
augggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgcc

SEQ ID NO: 11020 - RNA, 2073 nt, Artificial Sequence
  ZIKV (strain ZikaSPH2015) prME-short variant CDS opt
augaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 11021 - RNA, 2073 nt, Artificial Sequence
  ZIKV (isolate Z1106033) prME-short variant CDS opt
augaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgcc

SEQ ID NO: 11022 - RNA, 2061 nt, Artificial Sequence
  ZIKV (strain MR 766) prME-short variant CDS opt
augaacgagggcagcaucauguggcuggccucccucgccguggucaucgcgugcgccggggccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgcc

SEQ ID NO: 11023 - RNA, 2073 nt, Artificial Sequence
  ZIKV (strain NatalRGN) prME-short variant CDS opt
augaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgcc

SEQ ID NO: 11024 - RNA, 2100 nt, Artificial Sequence
  ZIKV (strain ZikaSPH2015) prME-short variant CDS opt
augggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 11025 - RNA, 2100 nt, Artificial Sequence
  ZIKV (isolate Z1106033) prME-short variant CDS opt
augggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 11026 - RNA, 2088 nt, Artificial Sequence
  ZIKV (strain MR 766) prME-short variant CDS opt
augggccggaagcagaacaagcgcgggggcaacgaggggagcaucauguggcuggccucccucgccguggucaucgcgugcgccggcgccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 11027 - RNA, 2100 nt, Artificial Sequence
  ZIKV (strain NatalRGN) prME-short variant CDS opt
augggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 11028 - RNA, 2073 nt, Artificial Sequence
  ZIKV (strain ZikaSPH2015) prME-short variant CDS opt
augaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 11029 - RNA, 2073 nt, Artificial Sequence
  ZIKV (isolate Z1106033) prME-short variant CDS opt
augaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 11030 - RNA, 2061 nt, Artificial Sequence
  ZIKV (strain MR 766) prME-short variant CDS opt
augaacgagggcagcaucauguggcuggccucccucgccguggucaucgcgugcgccggggccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 11031 - RNA, 2073 nt, Artificial Sequence
  ZIKV (strain NatalRGN) prME-short variant CDS opt
augaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 11032 - RNA, 2100 nt, Artificial Sequence; identical to SEQ ID NO: 11016
  ZIKV (strain ZikaSPH2015) ME variant CDS opt

SEQ ID NO: 11033 - RNA, 2100 nt, Artificial Sequence; identical to SEQ ID NO: 11017
  ZIKV (isolate Z1106033) ME variant CDS opt

SEQ ID NO: 11034 - RNA, 2088 nt, Artificial Sequence; identical to SEQ ID NO: 11018
  ZIKV (strain MR 766) ME variant CDS opt

SEQ ID NO: 11035 - RNA, 2100 nt, Artificial Sequence; identical to SEQ ID NO: 11019
  ZIKV (strain NatalRGN) ME variant CDS opt

SEQ ID NO: 11036 - RNA, 2073 nt, Artificial Sequence; identical to SEQ ID NO: 11020
  ZIKV (strain ZikaSPH2015) ME variant CDS opt

SEQ ID NO: 11037 - RNA, 2073 nt, Artificial Sequence; identical to SEQ ID NO: 11021
  ZIKV (isolate Z1106033) ME variant CDS opt

SEQ ID NO: 11038 - RNA, 2061 nt, Artificial Sequence; identical to SEQ ID NO: 11022
  ZIKV (strain MR 766) ME variant CDS opt

SEQ ID NO: 11039 - RNA, 2073 nt, Artificial Sequence; identical to SEQ ID NO: 11023
  ZIKV (strain NatalRGN) ME variant CDS opt

SEQ ID NO: 11040 - RNA, 2100 nt, Artificial Sequence
  ZIKV (strain ZikaSPH2015) prME-short variant CDS opt
augggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 11041 - RNA, 2100 nt, Artificial Sequence
  ZIKV (isolate Z1106033) prME-short variant CDS opt
augggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgcc

SEQ ID NO: 11042 - RNA, 2088 nt, Artificial Sequence
  ZIKV (strain MR 766) prME-short variant CDS opt
augggccgcaagcagaacaagcgcggcggcaacgagggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 11043 - RNA, 2100 nt, Artificial Sequence
  ZIKV (strain NatalRGN) prME-short variant CDS opt
augggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 11044 - RNA, 2073 nt, Artificial Sequence
  ZIKV (strain ZikaSPH2015) prME-short variant CDS opt
augaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 11045 - RNA, 2073 nt, Artificial Sequence
  ZIKV (isolate Z1106033) prME-short variant CDS opt
augaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgcc

SEQ ID NO: 11046 - RNA, 2061 nt, Artificial Sequence
  ZIKV (strain MR 766) prME-short variant CDS opt
augaacgagggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 11047 - RNA, 2073 nt, Artificial Sequence
  ZIKV (strain NatalRGN) prME-short variant CDS opt
augaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 11048 - RNA, 2100 nt, Artificial Sequence
  ZIKV (strain ZikaSPH2015) prME-short variant CDS opt
augggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 11049 - RNA, 2100 nt, Artificial Sequence
  ZIKV (isolate Z1106033) prME-short variant CDS opt
augggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 11050 - RNA, 2088 nt, Artificial Sequence
  ZIKV (strain MR 766) prME-short variant CDS opt
augggccgcaagcagaacaagcgcggcggcaacgagggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 11051 - RNA, 2100 nt, Artificial Sequence
  ZIKV (strain NatalRGN) prME-short variant CDS opt
augggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 11052 - RNA, 2073 nt, Artificial Sequence
  ZIKV (strain ZikaSPH2015) prME-short variant CDS opt
augaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 11053 - RNA, 2073 nt, Artificial Sequence
  ZIKV (isolate Z1106033) prME-short variant CDS opt
augaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 11054 - RNA, 2061 nt, Artificial Sequence
  ZIKV (strain MR 766) prME-short variant CDS opt
augaacgagggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 11055 - RNA, 2073 nt, Artificial Sequence
  ZIKV (strain NatalRGN) prME-short variant CDS opt
augaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 11056 - RNA, 2100 nt, Artificial Sequence; identical to SEQ ID NO: 11040
  ZIKV (strain ZikaSPH2015) ME variant CDS opt

SEQ ID NO: 11057 - RNA, 2100 nt, Artificial Sequence; identical to SEQ ID NO: 11041
  ZIKV (isolate Z1106033) ME variant CDS opt

SEQ ID NO: 11058 - RNA, 2088 nt, Artificial Sequence; identical to SEQ ID NO: 11042
  ZIKV (strain MR 766) ME variant CDS opt

SEQ ID NO: 11059 - RNA, 2100 nt, Artificial Sequence; identical to SEQ ID NO: 11043
  ZIKV (strain NatalRGN) ME variant CDS opt

SEQ ID NO: 11060 - RNA, 2073 nt, Artificial Sequence; identical to SEQ ID NO: 11044
  ZIKV (strain ZikaSPH2015) ME variant CDS opt

SEQ ID NO: 11061 - RNA, 2073 nt, Artificial Sequence; identical to SEQ ID NO: 11045
  ZIKV (isolate Z1106033) ME variant CDS opt

SEQ ID NO: 11062 - RNA, 2061 nt, Artificial Sequence; identical to SEQ ID NO: 11046
  ZIKV (strain MR 766) ME variant CDS opt

SEQ ID NO: 11063 - RNA, 2073 nt, Artificial Sequence; identical to SEQ ID NO: 11047
  ZIKV (strain NatalRGN) ME variant CDS opt

SEQ ID NO: 11064 - RNA, 2100 nt, Artificial Sequence
  ZIKV (strain ZikaSPH2015) prME-short variant CDS opt
augggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacaugugcgaugccacgaugaguuacgaguguccuauguuagacgaagggguggagccagaugacguagauugcugguguaacaccacaagcacuuggguggucuauggaaccugccaucacaaaaagggcgaagcucguagauccaggcgggcagugacacugccgucucauucgacccgcaaacuacagacuagaucacagacauggcucgagagcagggaguacaccaagcaccugauccggguugaaaauuggauuuuucgcaaccccggcuucgcccuugcugccgcggcaaucgccuggcuguuggggaguuccacgucucagaaggugauauaucucgucaugauccugcugauugcuccugccuacagcauccgauguauuggaguguccaauagagacuuuguagaggguaugucaggcgggacuuggguugauaucgugcucgaacauggaggcugcgucaccgugauggcacaagacaaaccaacaguggauauagaguuagucacuaccacaguuaguaacauggcugaggugaggagcuacuguuaugaagccucuauuuccgacauggcgucagauagccggugccccacccagggugaggccuaccuggacaagcagagugacacgcaguauguauguaaacguacucuuguggaucgcggguggggaaauggcugcggcuuguucgggaagggaucucuggucacaugcgcaaaauuugcuuguuccaagaagaugaccgguaaaagcauccaaccugaaaaccuagaguacagaauuaugcucucggugcacggcucucagcacuccgggaugaucguuaaugacacuggacaugaaacagaugagaacagggccaagguggagaucaccccaaauucaccccgggcugaagccacgcugggcgguuucgggagucuuggccuggacugcgagccucgaaccggauuggauuuuagcgaccucuauuaccugacaaugaacaauaaacacugguuaguccauaaggaaugguuccacgauauuccacugccguggcacgcaggcgccgacacugggacaccccauuggaacaacaaagaggcucucguggaauuuaaggaugcgcacgcaaaacgccagaccguaguugugcuuggaucccaggagggugccguccauacugcucuggccggcgcauuggaggccgaaauggacggggcuaagggaagacuaucuagcggccaccugaaguguaggcucaaaauggauaagcugcggcuuaaaggugugucauauagucugugcaccgccgcauucacauuuaccaagauaccugcggagacuuugcaugggacggucacaguggaaguucaauacgcuggcaccgacggaccauguaaagugcccgcccagauggcaguagacaugcagacucucaccccugucggccgccugaucacagccaauccagugauuaccgaguccacugaaaacagcaagaugauguuagagcuggaucccccguucggggacucuuacaucguuauaggagugggugagaagaaaauuacacaccacuggcauagaucaggcaguacgaucgggaaggcuuuugaagccaccgucaggggagcaaaacguauggcugugcuaggcgauacugccugggacuucgguagcguagggggcgcgcucaauucccugggaaagggcauccaccaaauuuucggggccgcuuuuaaaucucuuuucggaggcaugucgugguuuagccagaucuugauugguacacugcucauguggcuggggcuuaacaccaagaauggauccauaucacugaugugcuuggcacucggcggugugcugaucuucuuaaguacagccguuucugcu

SEQ ID NO: 11065 - RNA, 2100 nt, Artificial Sequence
  ZIKV (isolate Z1106033) prME-short variant CDS opt
augggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacacgugcgaugccaccaugaguuacgaguguccuauguuagacgaagggguggagccagaugacguagauugcugguguaacacaacuagcaccuggguggucuauggaacaugccaucacaaaaagggcgaagcucguagauccaggcgggcagugacccugccgucucauucgacucgcaaacuacagacaagaucacagaccuggcucgagagcagggaguacacgaagcaccugauccggguugaaaauuggauuuuucgcaaccccggcuucgcccuugcugccgcggcaaucgccuggcuguuggggaguuccacuucucagaaggugauauaucucgucaugauccugcugauugcuccugccuacagcauccgauguauuggaguguccaauagagacuuuguagaggguaugucaggcgggaccuggguugaugugguccucgaacauggaggcugcgugacagugauggcacaagacaaaccaacugucgauaucgaguuaguuaccacaaccgugaguaacauggcugagguaaggagcuacuguuaugaagccucuauauccgacauggcgucagauagccggugccccacgcagggugaggccuaccuggacaagcagagugacacucaguauguguguaaacguacacuugucgaucgcggguggggaaauggcugcggcuuguucgggaagggaucucuggugaccugcgcaaaauuugcuuguuccaagaagaugacugguaaaagcauucaaccugaaaaccuagaguacagaaucaugcucucgguucacggcucucagcacuccgggaugauugugaaugacacaggacaugaaaccgaugagaacagggccaaggucgagaucacgccaaauucaccccgggcugaagccacccugggcgguuucgggagucuuggccuggacugcgagccucgaacaggauuggauuuuagcgaccucuauuaccugacuaugaacaauaaacacugguuagugcauaaggaaugguuccacgauaucccacugccguggcacgcaggcgccgacaccgggacaccccauuggaacaacaaagaggcucucguagaauuuaaggaugcgcacgcaaaacgccagacuguugugguccuuggaucccaggagggugccgugcauaccgcucuggccggcgcauuggaggccgaaauggacggggcuaagggaagacuaucuagcggccaccugaaguguaggcucaaaauggauaagcugcggcuuaaaggugucucauauagucugugcacagccgcauucaccuuuacuaagauuccugcggagacguugcaugggacagugaccguugaagugcaauacgcuggcacugacggaccauguaaaguacccgcccagauggcagucgacaugcagacccucacaccugugggccgccugauaaccgccaauccaguuaucacugaguccacagaaaacagcaagaugauguuagagcuggaucccccguucggggacucuuacauugugaucggagucggugagaagaaaauaacgcaccacuggcauagaucaggcaguaccauugggaaggcuuuugaagccacugugaggggagcaaaacguauggcuguacuaggcgauacagccugggacuucgguagcguugggggcgcgcucaauucccugggaaagggcauccaccaaaucuucggggccgcuuuuaaaucucuuuucggaggcaugucgugguuuagccagauuuugaucgguacccugcucauguggcuggggcuuaacgcaaagaauggauccauuucacugaugugcuuggcccucggcggugugcugauauucuuaaguacagcugucucugcc

SEQ ID NO: 11066 - RNA, 2088 nt, Artificial Sequence
  ZIKV (strain MR 766) prME-short variant CDS opt
augggcagaaagcagaacaaaaggggagggaaugaggguagcaucauguggcuggccucccucgcuguggucauugcaugcgccggcgcgauaacccggcgcgggucugcuuacuauauguaccuugaccgaucagaugccggaaaggcaaucaguuucgccacaacucugggcguuaacaaaugucacgugcaaauuauggacuugggucauaugugcgaugcuacgaugagcuaugaaugucccauguuagacgaggggguagaaccugaugacguggauugcugguguaauaccacauccacuugggucguguacggaaccugccaccauaagaaaggcgaggcacguagaucuaggcgggccguuacacugccaucgcacucaacccgcaagcuacagacuagaagccagacauggcucgaaaguagggaguauaccaagcaucugaucaaaguggagaacuggauuuuucggaauccgggcuucgcucuugucgccguggcgaucgcauggcuguugggguccucuacgagccagaagguaauauaccucguuaugauccugcugauugcccccgcuuauuccauccgcuguauuggagugucaaaccgagacuuugucgaagguaugaguggcgggacuuggguggaugugguccucgagcacggaggcugcguuaccgugauggcccaagacaaaccuacaguagauaucgaauuagugacuaccacagucagcaauauggcagaggugagaucuuacuguuacgaggcuuccauaucagacauggccagcgauaguaggugcccaacccagggugaagcguaucuggacaagcagucugacacgcaguacguuuguaaacggacucuuguggaucguggguggggaaacggcugcggcuuguucgggaagggaucccuggucacaugcgccaaguuuaccuguagcaaaaagaugacugguaaaucgauucaacccgagaaucuagaauaucgcaucaugcucucugugcacggcucccagcauucagggaugauuggauacgagacagacgaagauagagcaaagguagagguuaccccuaacaguccaagggcugaggccacgcugggcgguuucgggagccuuggccuggacugcgaaccccggaccggauuggauuuuuccgaccucuauuaccugacaaugaauaacaaacacugguuagugcauaaggagugguuccacgauaucccucugccauggcacgcuggcgccgacacugggaccccgcauuggaauaacaaagaagcacucgucgaguuuaaggaugcccacgcuaagcgacagacaguggucgugcuuggaucucaggaaggugcgguucauacugcacuggccggcgcuuuggaggccgagauggacggggcaaaaggacgccuauucagcggccaccugaaguguagacucaaaauggauaagcugaggcuuaaaggugugucauauagucugugcaccgccgcuuuuacauucaccaagguacccgccgaaacuuugcaugggacggucacaguggagguucaauacgcaggcaccgacggaccuuguaagaucccagugcagauggcggucgacaugcagacucucacccccgugggccggcugauuacagcuaauccuguaauaaccgaauccacugagaacagcaaaaugauguuagaacuggauccacccuuuggggacucuuacaucgugauuggaguuggugauaagaaaaucacacaccacuggcaucgcucaggcaguacgauagggaaggccuucgaggcaaccgucagaggagccaaaaggauggcugugcuaggcgacacugccugggauuucgguagcgucgggggcguguuuaacucccucggaaagggcauucaccaaaucuucggggcagcuuuuaagucucuguucggaggcaugucgugguuuagccagauccuuauugguacauugcugguuuggcucgggcugaauaccaaaaacggauccaucucacuuacaugccuggccuugggcggugugaugauuuuccucaguacugcggugucugcc

SEQ ID NO: 11067 - RNA, 2100 nt, Artificial Sequence
  ZIKV (strain NatalRGN) prME-short variant CDS opt
augggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacaugugcgaugccacgaugaguuacgaguguccuauguuagacgaagggguggagccagaugacguagauugcugguguaacaccacaagcacuuggguggucuauggaaccugccaucacaaaaagggcgaagcucguagauccaggcgggcagugacacugccgucucauucgacccgcaaacuacagacuagaucacagacauggcucgagagcagggaguacaccaagcaccugauccggguugaaaauuggauuuuucgcaaccccggcuucgcccuugcugccgcggcaaucgccuggcuguuggggaguuccacgucucagaaggugauauaucucgucaugauccugcugauugcuccugccuacagcauccgauguauuggaguguccaauagagacuuuguagaggguaugucaggcgggacuuggguugaugugguccucgaacauggaggcugcgugaccgugauggcacaagacaaaccaacagucgauaucgaguuaguuacuaccacagugaguaacauggcugagguaaggagcuacuguuaugaagccucuauauccgacauggcgucagauagccggugccccacccagggugaggccuaccuggacaagcagagugacacgcaguauguguguaaacguacucuugucgaucgcggguggggaaauggcugcggcuuguucgggaagggaucucuggugacaugcgcaaaauuugcuuguuccaagaagaugaccgguaaaagcauucaaccugaaaaccuagaguacagaaucaugcucucgguucacggcucucagcacuccgggaugauugugaaugacacuggacaugaaacagaugagaacagggccaaggucgagaucaccccaaauucaccccgggcugaagccacgcugggcgguuucgggagucuuggccuggacugcgagccucgaaccggauuggauuuuagcgaccucuauuaccugacaaugaacaauaaacacugguuagugcauaaggaaugguuccacgauaucccacugccguggcacgcaggcgccgacacugggacaccccauuggaacaacaaagaggcucucguagaauuuaaggaugcgcacgcaaaacgccagaccguugugguccuuggaucccaggagggugccgugcauacugcucuggccggcgcauuggaggccgaaauggacggggcuaagggaagacuaucuagcggccaccugaaguguaggcucaaaauggauaagcugcggcuuaaaggugucucauauagucugugcaccgccgcauucacauuuaccaagauuccugcggagacuuugcaugggacggugacaguugaagugcaauacgcuggcaccgacggaccauguaaaguacccgcccagauggcagucgacaugcagacucucaccccugugggccgccugauaacagccaauccaguuaucaccgaguccacugaaaacagcaagaugauguuagagcuggaucccccguucggggacucuuacauugugaucggagucggugagaagaaaauaacacaccacuggcauagaucaggcaguacgauugggaaggcuuuugaagccaccgugaggggagcaaaacguauggcuguacuaggcgauacugccugggacuucgguagcguugggggcgcgcucaauucccugggaaagggcauccaccaaaucuucggggccgcuuuuaaaucucuuuucggaggcaugucgugguuuagccagauuuugaucgguacacugcucauguggcuggggcuuaacaccaagaauggauccauuucacugaugugcuuggcacucggcggugugcugauauucuuaaguacagccgucucugcu

SEQ ID NO: 11068 - RNA, 2073 nt, Artificial Sequence
  ZIKV (strain ZikaSPH2015) prME-short variant CDS opt
augaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacaugugcgaugccacgaugaguuacgaguguccuauguuagacgaaggaguggagccagaugacguagauugcugguguaauaccacaagcacuuggguggucuaugguaccugccaucacaaaaagggcgaagcucgccgaucccguagagcagugacacugccgucucauucgaccaggaaacuacaaacucggucacagacauggcucgagagccgcgaguacaccaagcaccugaucagaguugaaaacuggauuuuuaggaaucccggguucgcccuugcugccgcggcaaucgccuggcuguugggaaguuccacgucucagaaagugauauaucucgucaugauccugcugauugcuccugccuacagcauccgguguauuggcguguccaaccgcgacuuuguagagggcaugucagggggaacuuggguugauaucgugcucgaacaugguggcugcgucaccgugauggcacaggacaagccaacaguggauauagaguuagucacuaccacaguuaguaauauggcugaggugcgaagcuacuguuaugaagccucuauuuccgacauggcgucagauagcagaugccccacccaaggggaggccuaccuggacaagcagagugacacgcaguauguauguaaaaggacucuuguggaucggggauggggcaacgguugcggguuguucggaaagggcucucuggucacaugcgcaaaauuugcuuguuccaagaaaaugaccggcaagagcauccagccugaaaaucuagaguaccguauuaugcucucggugcacgggucucaacacuccggaaugaucguuaacgacacuggucaugaaacagaugagaaucgcgccaagguggagaucaccccaaacucacccagagcugaagccacgcugggcggguucggaagucuuggccuggacugcgagccuaggaccgguuuggauuuuagcgaccucuauuaccugacaaugaauaacaaacacugguuaguccauaaggaaugguuccacgauauuccacugccguggcacgcaggggccgacacuggcacaccccauuggaauaacaaagaggcucucguggaauuuaaggaugcgcacgcaaaacggcagaccguaguugugcuuggaucccaggagggcgccguccauacugcucuggccggggcauuggaggccgaaauggacggagcuaagggucgacuaucuagcggccaccugaaaugucgccucaagauggauaagcugagacuuaaaggggugucauauagucugugcaccgccgcauucacauuuaccaagauaccugcggagacuuugcauggaacggucacaguggaaguucaguacgcuggcaccgacgguccauguaaagugcccgcccaaauggcaguagacaugcagacucucaccccugucgggaggcugaucacagccaacccagugauuaccgaguccacugaaaauagcaagaugauguuagagcuggaucccccguucggcgacucuuacaucguuauaggagugggcgagaaaaagauuacacaccacuggcaucggucagggaguacgaucggaaaggcuuuugaagccaccguccgcggugcaaaaagaauggcugugcuaggcgauacugccugggacuucgggagcguaggaggcgcgcucaacucccuggguaaggggauccaccagauuuucggcgccgcuuuuaaaucucuuuucggaggcaugucgugguuuagccaaaucuugauugggacacugcucauguggcugggacuuaauaccaagaacggcuccauaucacugaugugcuuggcacucgguggggugcugaucuucuuaaguacagccguuucugcu

SEQ ID NO: 11069 - RNA, 2073 nt, Artificial Sequence
  ZIKV (isolate Z1106033) prME-short variant CDS opt
augaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacacgugcgaugccaccaugaguuacgaguguccuauguuagacgaaggaguggagccagaugacguagauugcugguguaauacaacuagcaccuggguggucuauggcacaugccaucacaaaaagggugaagcucgccgaucccguagagcagugacccugccgucucauucgacuaggaaacuacaaacacggucacagaccuggcucgagagccgcgaguacacgaagcaccugaucagaguugaaaacuggauuuuuaggaaucccggguucgcccuugcugccgcggcaaucgccuggcuguugggaaguuccacuucucagaaagugauauaucucgucaugauccugcugauugcuccugccuacagcauccgguguauuggcguguccaaccgcgacuuuguagagggcaugucagggggaaccuggguugaugugguccucgaacaugguggcugcgugacagugauggcacaggacaagccaacugucgauaucgaguuaguuaccacaaccgugaguaauauggcugagguacgaagcuacuguuaugaagccucuauauccgacauggcgucagauagcagaugccccacgcaaggggaggccuaccuggacaagcagagugacacucaguauguguguaaaaggacacuugucgaucggggauggggcaacgguugcggguuguucggaaagggcucucuggugaccugcgcaaaauuugcuuguuccaagaaaaugacuggcaagagcauucagccugaaaaucuagaguaccguaucaugcucucgguucacgggucucaacacuccggaaugauugugaacgacacaggucaugaaaccgaugagaaucgcgccaaggucgagaucacgccaaacucacccagagcugaagccacccugggcggguucggaagucuuggccuggacugcgagccuaggacagguuuggauuuuagcgaccucuauuaccugacuaugaauaacaaacacugguuagugcauaaggaaugguuccacgauaucccacugccguggcacgcaggggccgacaccggcacaccccauuggaauaacaaagaggcucucguagaauuuaaggaugcgcacgcaaaacggcagacuguugugguccuuggaucccaggagggcgccgugcauaccgcucuggccggggcauuggaggccgaaauggacggagcuaagggucgacuaucuagcggccaccugaaaugucgccucaagauggauaagcugagacuuaaaggggucucauauagucugugcacagccgcauucaccuuuacuaagauuccugcggagacguugcauggaacagugaccguugaagugcaguacgcuggcacugacgguccauguaaaguacccgcccaaauggcagucgacaugcagacccucacaccuguggggaggcugauaaccgccaacccaguuaucacugaguccacagaaaauagcaagaugauguuagagcuggaucccccguucggcgacucuuacauugugaucggagucggcgagaaaaagauaacgcaccacuggcaucggucagggaguaccauuggaaaggcuuuugaagccacugugcgcggugcaaaaagaauggcuguacuaggcgauacagccugggacuucgggagcgugggaggcgcgcucaacucccuggguaaggggauccaccagaucuucggcgccgcuuuuaaaucucuuuucggaggcaugucgugguuuagccaaauuuugaucgggacccugcucauguggcugggacuuaaugcaaagaacggcuccauuucacugaugugcuuggcccucggugggguucugauauucuuaaguacagcugucucugcc

SEQ ID NO: 11070 - RNA, 2061 nt, Artificial Sequence
  ZIKV (strain MR 766) prME-short variant CDS opt
augaacgagggcagcaucauguggcuggccucccucgcuguggucauugcaugcgccggggcgauaaccagaaggggaucugcuuacuauauguaccuugaccggucagaugccgguaaggcaaucaguuucgccacaacucugggcguuaauaaaugucacgugcagauuauggacuuggggcauaugugcgaugcuacgaugagcuaugaaugucccauguuagacgagggaguagaaccugaugacguggauugcugguguaacaccacauccacuugggucguguacgguaccugccaccauaagaaaggcgaggcacgccgaucucguagagccguuacacugccaucgcacucaaccaggaagcuacaaacucggagccagacauggcucgaaagucgcgaguauaccaaacaucugaucaagguggagaauuggauuuuuagaaacccgggguucgcucuugucgccguggcgaucgcauggcuguugggauccucuacgagccagaagguaauauaccucguuaugauccugcugauugcccccgcuuauuccaucagguguauuggcgugucaaaucgggacuuugucgaaggcaugagugggggaacuuggguggaugugguccucgagcacgguggcugcguuaccgugauggcccaggacaaaccuacaguagauaucgaauuagugacuaccacagucagcaacauggcagaggugcgcucuuacuguuacgaggcuuccauaucagacauggccagcgauagucgaugcccaacccaaggggaagcguaucuggacaagcagucugacacgcaguacguuuguaaaagaacucuuguggauaggggauggggcaaugguugcggguuguucggaaagggcucccuggucacaugcgccaaauuuaccuguagcaagaagaugacuggcaaaucgauucagcccgagaaccuagaauaucggaucaugcucucugugcacgggucccaacauucaggaaugauugguuacgagacagacgaagaucgugcaaagguagagguuaccccuaauaguccacgcgcugaggccacgcugggcggguucggaagccuuggccuggacugcgaacccagaaccgguuuggauuuuuccgaccucuauuaccugacaaugaacaauaaacacugguuagugcauaaggagugguuccacgauaucccucugccauggcacgcuggggccgacacuggcaccccgcauuggaacaauaaagaagcacucgucgaguuuaaggaugcccacgcuaaaaggcagacaguggucgugcuuggaucucaggaaggcgcgguucauacugcacuggccggggcuuuggaggccgagauggacggagcaaagggucggcuauucagcggccaccugaagugucgacucaaaauggauaagcugcgccuuaaaggggugucauauagucugugcaccgccgcuuuuacauucaccaagguacccgccgaaacuuugcauggaacggucacaguggagguucaguacgcaggcaccgacgguccuuguaaaaucccagugcaaauggcggucgacaugcagacucucacccccguggggagacugauuacagcuaacccuguaauaaccgaauccacugagaauagcaagaugauguuagaacuggauccacccuuuggcgacucuuacaucgugauuggaguuggcgauaagaaaaucacacaccacuggcauaggucagggaguacgauaggaaaggccuucgaggcaaccguccggggugccaaacgcauggcugugcuaggcgacacugccugggauuucgggagcgugggaggcgucuuuaacucccucgguaaggggauucaccagaucuucggcgcagcuuuuaaaucucuguucggaggcaugucgugguuuagccaaauccuuauugggacauugcugguuuggcucggacugaacaccaagaauggcuccaucucacuuacaugccuggccuuggguggggugaugauuuuccucaguacugcggugucugcc

SEQ ID NO: 11071 - RNA, 2073 nt, Artificial Sequence
  ZIKV (strain NatalRGN) prME-short variant CDS opt
augaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacaugugcgaugccacgaugaguuacgaguguccuauguuagacgaaggaguggagccagaugacguagauugcugguguaauaccacaagcacuuggguggucuaugguaccugccaucacaaaaagggcgaagcucgccgaucccguagagcagugacacugccgucucauucgaccaggaaacuacaaacucggucacagacauggcucgagagccgcgaguacaccaagcaccugaucagaguugaaaacuggauuuuuaggaaucccggguucgcccuugcugccgcggcaaucgccuggcuguugggaaguuccacgucucagaaagugauauaucucgucaugauccugcugauugcuccugccuacagcauccgguguauuggcguguccaaccgcgacuuuguagagggcaugucagggggaacuuggguugaugugguccucgaacaugguggcugcgugaccgugauggcacaggacaagccaacagucgauaucgaguuaguuacuaccacagugaguaauauggcugagguacgaagcuacuguuaugaagccucuauauccgacauggcgucagauagcagaugccccacccaaggggaggccuaccuggacaagcagagugacacgcaguauguguguaaaaggacucuugucgaucggggauggggcaacgguugcggguuguucggaaagggcucucuggugacaugcgcaaaauuugcuuguuccaagaaaaugaccggcaagagcauucagccugaaaaucuagaguaccguaucaugcucucgguucacgggucucaacacuccggaaugauugugaacgacacuggucaugaaacagaugagaaucgcgccaaggucgagaucaccccaaacucacccagagcugaagccacgcugggcggguucggaagucuuggccuggacugcgagccuaggaccgguuuggauuuuagcgaccucuauuaccugacaaugaauaacaaacacugguuagugcauaaggaaugguuccacgauaucccacugccguggcacgcaggggccgacacuggcacaccccauuggaauaacaaagaggcucucguagaauuuaaggaugcgcacgcaaaacggcagaccguugugguccuuggaucccaggagggcgccgugcauacugcucuggccggggcauuggaggccgaaauggacggagcuaagggucgacuaucuagcggccaccugaaaugucgccucaagauggauaagcugagacuuaaaggggucucauauagucugugcaccgccgcauucacauuuaccaagauuccugcggagacuuugcauggaacggugacaguugaagugcaguacgcuggcaccgacgguccauguaaaguacccgcccaaauggcagucgacaugcagacucucaccccuguggggaggcugauaacagccaacccaguuaucaccgaguccacugaaaauagcaagaugauguuagagcuggaucccccguucggcgacucuuacauugugaucggagucggcgagaaaaagauaacacaccacuggcaucggucagggaguacgauuggaaaggcuuuugaagccaccgugcgcggugcaaaaagaauggcuguacuaggcgauacugccugggacuucgggagcgugggaggcgcgcucaacucccuggguaaggggauccaccagaucuucggcgccgcuuuuaaaucucuuuucggaggcaugucgugguuuagccaaauuuugaucgggacacugcucauguggcugggacuuaauaccaagaacggcuccauuucacugaugugcuuggcacucggugggguucugauauucuuaaguacagccgucucugcu

SEQ ID NO: 11072 - RNA, 2100 nt, Artificial Sequence
  ZIKV (strain ZikaSPH2015) prME-short variant CDS opt
augggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacaugugcgaugccacgaugaguuacgaguguccuauguuagacgaagggguggagccagaugacguagauugcugguguaacaccacaagcacuuggguggucuauggaaccugccaucacaaaaagggcgaagcucguagauccaggcgggcagugacacugccgucucauucgacccgcaaacuacagacuagaucacagacauggcucgagagcagggaguacaccaagcaccugauccggguugaaaauuggauuuuucgcaaccccggcuucgcccuugcugccgcggcaaucgccuggcuguuggggaguuccacgucucagaaggugauauaucucgucaugauccugcugauugcuccugccuacagcauccgauguauuggaguguccaauagagacuuuguagaggguaugucaggcgggacuuggguugauaucgugcucgaacauggaggcugcgucaccgugauggcacaagacaaaccaacaguggauauagaguuagucacuaccacaguuaguaacauggcugaggugaggagcuacuguuaugaagccucuauuuccgacauggcgucagauagccggugccccacccagggugaggccuaccuggacaagcagagugacacgcaguauguauguaaacguacucuuguggaucgcggguggggaaauggcugcggcuuguucgggaagggaucucuggucacaugcgcaaaauuugcuuguuccaagaagaugaccgguaaaagcauccaaccugaaaaccuagaguacagaauuaugcucucggugcacggcucucagcacuccgggaugaucguuaaugacacuggacaugaaacagaugagaacagggccaagguggagaucaccccaaauucaccccgggcugaagccacgcugggcgguuucgggagucuuggccuggacugcgagccucgaaccggauuggauuuuagcgaccucuauuaccugacaaugaacaauaaacacugguuaguccauaaggaaugguuccacgauauuccacugccguggcacgcaggcgccgacacugggacaccccauuggaacaacaaagaggcucucguggaauuuaaggaugcgcacgcaaaacgccagaccguaguugugcuuggaucccaggagggugccguccauacugcucuggccggcgcauuggaggccgaaauggacggggcuaagggaagacuaucuagcggccaccugaaguguaggcucaaaauggauaagcugcggcuuaaaggugugucauauagucugugcaccgccgcauucacauuuaccaagauaccugcggagacuuugcaugggacggucacaguggaaguucaauacgcuggcaccgacggaccauguaaagugcccgcccagauggcaguagacaugcagacucucaccccugucggccgccugaucacagccaauccagugauuaccgaguccacugaaaacagcaagaugauguuagagcuggaucccccguucggggacucuuacaucguuauaggagugggugagaagaaaauuacacaccacuggcauagaucaggcaguacgcuagggaaggcuuuuagcaccacucucaaaggagcccaaaggcuggcagcucuuggcgauacagccugggacuucgguuccaucgggggcgucuucaauucuaucggacgugcggugcaccagguauuuggcggggccuuccggaccuuguuuggaggcaugucguggauuacacagggucugaugggggcucuccugcuuuggaugggagugaacgcacgagauagaagcaucgcccuggcuuucuuggccacuggcgguguucucgucuuucuggcaaccaaugugcaugcg

SEQ ID NO: 11073 - RNA, 2100 nt, Artificial Sequence
  ZIKV (isolate Z1106033) prME-short variant CDS opt
augggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacacgugcgaugccaccaugaguuacgaguguccuauguuagacgaagggguggagccagaugacguagauugcugguguaacacaacuagcaccuggguggucuauggaacaugccaucacaaaaagggcgaagcucguagauccaggcgggcagugacccugccgucucauucgacucgcaaacuacagacaagaucacagaccuggcucgagagcagggaguacacgaagcaccugauccggguugaaaauuggauuuuucgcaaccccggcuucgcccuugcugccgcggcaaucgccuggcuguuggggaguuccacuucucagaaggugauauaucucgucaugauccugcugauugcuccugccuacagcauccgauguauuggaguguccaauagagacuuuguagaggguaugucaggcgggaccuggguugaugugguccucgaacauggaggcugcgugacagugauggcacaagacaaaccaacugucgauaucgaguuaguuaccacaaccgugaguaacauggcugagguaaggagcuacuguuaugaagccucuauauccgacauggcgucagauagccggugccccacgcagggugaggccuaccuggacaagcagagugacacucaguauguguguaaacguacacuugucgaucgcggguggggaaauggcugcggcuuguucgggaagggaucucuggugaccugcgcaaaauuugcuuguuccaagaagaugacugguaaaagcauucaaccugaaaaccuagaguacagaaucaugcucucgguucacggcucucagcacuccgggaugauugugaaugacacaggacaugaaaccgaugagaacagggccaaggucgagaucacgccaaauucaccccgggcugaagccacccugggcgguuucgggagucuuggccuggacugcgagccucgaacaggauuggauuuuagcgaccucuauuaccugacuaugaacaauaaacacugguuagugcauaaggaaugguuccacgauaucccacugccguggcacgcaggcgccgacaccgggacaccccauuggaacaacaaagaggcucucguagaauuuaaggaugcgcacgcaaaacgccagacuguugugguccuuggaucccaggagggugccgugcauaccgcucuggccggcgcauuggaggccgaaauggacggggcuaagggaagacuaucuagcggccaccugaaguguaggcucaaaauggauaagcugcggcuuaaaggugucucauauagucugugcacagccgcauucaccuuuacuaagauuccugcggagacguugcaugggacagugaccguugaagugcaauacgcuggcacugacggaccauguaaaguacccgcccagauggcagucgacaugcagacccucacaccugugggccgccugauaaccgccaauccaguuaucacugaguccacagaaaacagcaagaugauguuagagcuggaucccccguucggggacucuuacauugugaucggagucggugagaagaaaauaacgcaccacuggcauagaucaggcaguacccuagggaaggcuuuuagcacuacacucaaaggagcccaaaggcuggcagcucuuggcgauaccgccugggacuucgguuccauugggggcguguucaauucuaucggacgugcgguacaccagguguuuggcggggccuuccggacauuguuuggaggcaugucguggaucacucagggucugaugggggcucuccugcuuuggaugggaguuaacgcacgagauagaagcauugcccuggcuuucuuggccaccggcgguguccucguguuucuggcaacgaaugugcaugcg

SEQ ID NO: 11074 - RNA, 2088 nt, Artificial Sequence
  ZIKV (strain MR 766) prME-short variant CDS opt
augggcagaaagcagaacaaaaggggagggaaugaggguagcaucauguggcuggccucccucgcuguggucauugcaugcgccggcgcgauaacccggcgcgggucugcuuacuauauguaccuugaccgaucagaugccggaaaggcaaucaguuucgccacaacucugggcguuaacaaaugucacgugcaaauuauggacuugggucauaugugcgaugcuacgaugagcuaugaaugucccauguuagacgaggggguagaaccugaugacguggauugcugguguaauaccacauccacuugggucguguacggaaccugccaccauaagaaaggcgaggcacguagaucuaggcgggccguuacacugccaucgcacucaacccgcaagcuacagacuagaagccagacauggcucgaaaguagggaguauaccaagcaucugaucaaaguggagaacuggauuuuucggaauccgggcuucgcucuugucgccguggcgaucgcauggcuguugggguccucuacgagccagaagguaauauaccucguuaugauccugcugauugcccccgcuuauuccauccgcuguauuggagugucaaaccgagacuuugucgaagguaugaguggcgggacuuggguggaugugguccucgagcacggaggcugcguuaccgugauggcccaagacaaaccuacaguagauaucgaauuagugacuaccacagucagcaauauggcagaggugagaucuuacuguuacgaggcuuccauaucagacauggccagcgauaguaggugcccaacccagggugaagcguaucuggacaagcagucugacacgcaguacguuuguaaacggacucuuguggaucguggguggggaaacggcugcggcuuguucgggaagggaucccuggucacaugcgccaaguuuaccuguagcaaaaagaugacugguaaaucgauucaacccgagaaucuagaauaucgcaucaugcucucugugcacggcucccagcauucagggaugauuggauacgagacagacgaagauagagcaaagguagagguuaccccuaacaguccaagggcugaggccacgcugggcgguuucgggagccuuggccuggacugcgaaccccggaccggauuggauuuuuccgaccucuauuaccugacaaugaauaacaaacacugguuagugcauaaggagugguuccacgauaucccucugccauggcacgcuggcgccgacacugggaccccgcauuggaauaacaaagaagcacucgucgaguuuaaggaugcccacgcuaagcgacagacaguggucgugcuuggaucucaggaaggugcgguucauacugcacuggccggcgcuuuggaggccgagauggacggggcaaaaggacgccuauucagcggccaccugaaguguagacucaaaauggauaagcugaggcuuaaaggugugucauauagucugugcaccgccgcuuuuacauucaccaagguacccgccgaaacuuugcaugggacggucacaguggagguucaauacgcaggcaccgacggaccuuguaagaucccagugcagauggcggucgacaugcagacucucacccccgugggccggcugauuacagcuaauccuguaauaaccgaauccacugagaacagcaaaaugauguuagaacuggauccacccuuuggggacucuuacaucgugauuggaguuggugauaagaaaaucacacaccacuggcaucgcucaggcaguacgcuagggaaggccuucagcaccacucucaaaggagcacaaagacuggccgcucuuggcgacacagccugggauuucgguuccauagggggcgucuuuaacucuauuggaagggcagugcaccagguguucggcggggcuuuucguaccuuguucggaggcaugucguggaucacacagggucugaugggggcccuccugcuuuggaugggagucaaugcgcgggaccgaagcaucgcccuggcauuuuuggcuacuggcgguguucucguguuccuggccaccaacgugcaugcu

SEQ ID NO: 11075 - RNA, 2100 nt, Artificial Sequence
  ZIKV (strain NatalRGN) prME-short variant CDS opt
augggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacaugugcgaugccacgaugaguuacgaguguccuauguuagacgaagggguggagccagaugacguagauugcugguguaacaccacaagcacuuggguggucuauggaaccugccaucacaaaaagggcgaagcucguagauccaggcgggcagugacacugccgucucauucgacccgcaaacuacagacuagaucacagacauggcucgagagcagggaguacaccaagcaccugauccggguugaaaauuggauuuuucgcaaccccggcuucgcccuugcugccgcggcaaucgccuggcuguuggggaguuccacgucucagaaggugauauaucucgucaugauccugcugauugcuccugccuacagcauccgauguauuggaguguccaauagagacuuuguagaggguaugucaggcgggacuuggguugaugugguccucgaacauggaggcugcgugaccgugauggcacaagacaaaccaacagucgauaucgaguuaguuacuaccacagugaguaacauggcugagguaaggagcuacuguuaugaagccucuauauccgacauggcgucagauagccggugccccacccagggugaggccuaccuggacaagcagagugacacgcaguauguguguaaacguacucuugucgaucgcggguggggaaauggcugcggcuuguucgggaagggaucucuggugacaugcgcaaaauuugcuuguuccaagaagaugaccgguaaaagcauucaaccugaaaaccuagaguacagaaucaugcucucgguucacggcucucagcacuccgggaugauugugaaugacacuggacaugaaacagaugagaacagggccaaggucgagaucaccccaaauucaccccgggcugaagccacgcugggcgguuucgggagucuuggccuggacugcgagccucgaaccggauuggauuuuagcgaccucuauuaccugacaaugaacaauaaacacugguuagugcauaaggaaugguuccacgauaucccacugccguggcacgcaggcgccgacacugggacaccccauuggaacaacaaagaggcucucguagaauuuaaggaugcgcacgcaaaacgccagaccguugugguccuuggaucccaggagggugccgugcauacugcucuggccggcgcauuggaggccgaaauggacggggcuaagggaagacuaucuagcggccaccugaaguguaggcucaaaauggauaagcugcggcuuaaaggugucucauauagucugugcaccgccgcauucacauuuaccaagauuccugcggagacuuugcaugggacggugacaguugaagugcaauacgcuggcaccgacggaccauguaaaguacccgcccagauggcagucgacaugcagacucucaccccugugggccgccugauaacagccaauccaguuaucaccgaguccacugaaaacagcaagaugauguuagagcuggaucccccguucggggacucuuacauugugaucggagucggugagaagaaaauaacacaccacuggcauagaucaggcaguacgcuagggaaggcuuuuagcaccacucucaaaggagcccaaaggcuggcagcucuuggcgauacagccugggacuucgguuccauugggggcguguucaauucuaucggacgugcgguacaccagguguuuggcggggccuuccggaccuuguuuggaggcaugucguggaucacacagggucugaugggggcucuccugcuuuggaugggaguuaacgcacgagauagaagcauugcccuggcuuucuuggccacuggcgguguccucguguuucuggcaaccaaugugcaugcg

SEQ ID NO: 11076 - RNA, 2073 nt, Artificial Sequence
  ZIKV (strain ZikaSPH2015) prME-short variant CDS opt
augaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacaugugcgaugccacgaugaguuacgaguguccuauguuagacgaaggaguggagccagaugacguagauugcugguguaauaccacaagcacuuggguggucuaugguaccugccaucacaaaaagggcgaagcucgccgaucccguagagcagugacacugccgucucauucgaccaggaaacuacaaacucggucacagacauggcucgagagccgcgaguacaccaagcaccugaucagaguugaaaacuggauuuuuaggaaucccggguucgcccuugcugccgcggcaaucgccuggcuguugggaaguuccacgucucagaaagugauauaucucgucaugauccugcugauugcuccugccuacagcauccgguguauuggcguguccaaccgcgacuuuguagagggcaugucagggggaacuuggguugauaucgugcucgaacaugguggcugcgucaccgugauggcacaggacaagccaacaguggauauagaguuagucacuaccacaguuaguaauauggcugaggugcgaagcuacuguuaugaagccucuauuuccgacauggcgucagauagcagaugccccacccaaggggaggccuaccuggacaagcagagugacacgcaguauguauguaaaaggacucuuguggaucggggauggggcaacgguugcggguuguucggaaagggcucucuggucacaugcgcaaaauuugcuuguuccaagaaaaugaccggcaagagcauccagccugaaaaucuagaguaccguauuaugcucucggugcacgggucucaacacuccggaaugaucguuaacgacacuggucaugaaacagaugagaaucgcgccaagguggagaucaccccaaacucacccagagcugaagccacgcugggcggguucggaagucuuggccuggacugcgagccuaggaccgguuuggauuuuagcgaccucuauuaccugacaaugaauaacaaacacugguuaguccauaaggaaugguuccacgauauuccacugccguggcacgcaggggccgacacuggcacaccccauuggaauaacaaagaggcucucguggaauuuaaggaugcgcacgcaaaacggcagaccguaguugugcuuggaucccaggagggcgccguccauacugcucuggccggggcauuggaggccgaaauggacggagcuaagggucgacuaucuagcggccaccugaaaugucgccucaagauggauaagcugagacuuaaaggggugucauauagucugugcaccgccgcauucacauuuaccaagauaccugcggagacuuugcauggaacggucacaguggaaguucaguacgcuggcaccgacgguccauguaaagugcccgcccaaauggcaguagacaugcagacucucaccccugucgggaggcugaucacagccaacccagugauuaccgaguccacugaaaauagcaagaugauguuagagcuggaucccccguucggcgacucuuacaucguuauaggagugggcgagaaaaagauuacacaccacuggcaucggucagggaguacgcuaggaaaggcuuuuagcaccacucucaaaggugcccagcgccuggcagcucuuggcgauacagccugggacuucggguccaucggaggcgucuucaacucuaucgguagagcggugcaccaaguauuugggggcgccuucaggaccuuguuuggaggcaugucguggauuacacaggggcugaugggagcucuccugcuuuggaugggcgugaaugcacgugaucggagcaucgcccuggcuuucuuggccacuggugggguucucgucuuucuggcaaccaacgugcaugcg

SEQ ID NO: 11077 - RNA, 2073 nt, Artificial Sequence
  ZIKV (isolate Z1106033) prME-short variant CDS opt
augaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacacgugcgaugccaccaugaguuacgaguguccuauguuagacgaaggaguggagccagaugacguagauugcugguguaauacaacuagcaccuggguggucuauggcacaugccaucacaaaaagggugaagcucgccgaucccguagagcagugacccugccgucucauucgacuaggaaacuacaaacacggucacagaccuggcucgagagccgcgaguacacgaagcaccugaucagaguugaaaacuggauuuuuaggaaucccggguucgcccuugcugccgcggcaaucgccuggcuguugggaaguuccacuucucagaaagugauauaucucgucaugauccugcugauugcuccugccuacagcauccgguguauuggcguguccaaccgcgacuuuguagagggcaugucagggggaaccuggguugaugugguccucgaacaugguggcugcgugacagugauggcacaggacaagccaacugucgauaucgaguuaguuaccacaaccgugaguaauauggcugagguacgaagcuacuguuaugaagccucuauauccgacauggcgucagauagcagaugccccacgcaaggggaggccuaccuggacaagcagagugacacucaguauguguguaaaaggacacuugucgaucggggauggggcaacgguugcggguuguucggaaagggcucucuggugaccugcgcaaaauuugcuuguuccaagaaaaugacuggcaagagcauucagccugaaaaucuagaguaccguaucaugcucucgguucacgggucucaacacuccggaaugauugugaacgacacaggucaugaaaccgaugagaaucgcgccaaggucgagaucacgccaaacucacccagagcugaagccacccugggcggguucggaagucuuggccuggacugcgagccuaggacagguuuggauuuuagcgaccucuauuaccugacuaugaauaacaaacacugguuagugcauaaggaaugguuccacgauaucccacugccguggcacgcaggggccgacaccggcacaccccauuggaauaacaaagaggcucucguagaauuuaaggaugcgcacgcaaaacggcagacuguugugguccuuggaucccaggagggcgccgugcauaccgcucuggccggggcauuggaggccgaaauggacggagcuaagggucgacuaucuagcggccaccugaaaugucgccucaagauggauaagcugagacuuaaaggggucucauauagucugugcacagccgcauucaccuuuacuaagauuccugcggagacguugcauggaacagugaccguugaagugcaguacgcuggcacugacgguccauguaaaguacccgcccaaauggcagucgacaugcagacccucacaccuguggggaggcugauaaccgccaacccaguuaucacugaguccacagaaaauagcaagaugauguuagagcuggaucccccguucggcgacucuuacauugugaucggagucggcgagaaaaagauaacgcaccacuggcaucggucagggaguacccuaggaaaggcuuuuagcacuacacucaaaggugcccagcgccuggcagcucuuggcgauaccgccugggacuucggguccauuggaggcguguucaacucuaucgguagagcgguacaccaaguguuugggggcgccuucaggacauuguuuggaggcaugucguggaucacucaggggcugaugggagcucuccugcuuuggaugggcguuaaugcacgugaucggagcauugcccuggcuuucuuggccaccggugggguccucguguuucuggcaacgaacgugcaugcg

SEQ ID NO: 11078 - RNA, 2061 nt, Artificial Sequence
  ZIKV (strain MR 766) prME-short variant CDS opt
augaacgagggcagcaucauguggcuggccucccucgcuguggucauugcaugcgccggggcgauaaccagaaggggaucugcuuacuauauguaccuugaccggucagaugccgguaaggcaaucaguuucgccacaacucugggcguuaauaaaugucacgugcagauuauggacuuggggcauaugugcgaugcuacgaugagcuaugaaugucccauguuagacgagggaguagaaccugaugacguggauugcugguguaacaccacauccacuugggucguguacgguaccugccaccauaagaaaggcgaggcacgccgaucucguagagccguuacacugccaucgcacucaaccaggaagcuacaaacucggagccagacauggcucgaaagucgcgaguauaccaaacaucugaucaagguggagaauuggauuuuuagaaacccgggguucgcucuugucgccguggcgaucgcauggcuguugggauccucuacgagccagaagguaauauaccucguuaugauccugcugauugcccccgcuuauuccaucagguguauuggcgugucaaaucgggacuuugucgaaggcaugagugggggaacuuggguggaugugguccucgagcacgguggcugcguuaccgugauggcccaggacaaaccuacaguagauaucgaauuagugacuaccacagucagcaacauggcagaggugcgcucuuacuguuacgaggcuuccauaucagacauggccagcgauagucgaugcccaacccaaggggaagcguaucuggacaagcagucugacacgcaguacguuuguaaaagaacucuuguggauaggggauggggcaaugguugcggguuguucggaaagggcucccuggucacaugcgccaaauuuaccuguagcaagaagaugacuggcaaaucgauucagcccgagaaccuagaauaucggaucaugcucucugugcacgggucccaacauucaggaaugauugguuacgagacagacgaagaucgugcaaagguagagguuaccccuaauaguccacgcgcugaggccacgcugggcggguucggaagccuuggccuggacugcgaacccagaaccgguuuggauuuuuccgaccucuauuaccugacaaugaacaauaaacacugguuagugcauaaggagugguuccacgauaucccucugccauggcacgcuggggccgacacuggcaccccgcauuggaacaauaaagaagcacucgucgaguuuaaggaugcccacgcuaaaaggcagacaguggucgugcuuggaucucaggaaggcgcgguucauacugcacuggccggggcuuuggaggccgagauggacggagcaaagggucggcuauucagcggccaccugaagugucgacucaaaauggauaagcugcgccuuaaaggggugucauauagucugugcaccgccgcuuuuacauucaccaagguacccgccgaaacuuugcauggaacggucacaguggagguucaguacgcaggcaccgacgguccuuguaaaaucccagugcaaauggcggucgacaugcagacucucacccccguggggagacugauuacagcuaacccuguaauaaccgaauccacugagaauagcaagaugauguuagaacuggauccacccuuuggcgacucuuacaucgugauuggaguuggcgauaagaaaaucacacaccacuggcauaggucagggaguacgcuaggaaaggccuucagcaccacucucaaaggugcacagcggcuggccgcucuuggcgacacagccugggauuucggguccauaggaggcgucuuuaacucuauuggucgcgcagugcaccaaguguucgggggcgcuuuuagaaccuuguucggaggcaugucguggaucacacaggggcugaugggagcccuccugcuuuggaugggcgucaacgcgagggaccguagcaucgcccuggcauuuuuggcuacuggugggguucucguguuccuggccaccaaugugcaugcu

SEQ ID NO: 11079 - RNA, 2073 nt, Artificial Sequence
  ZIKV (strain NatalRGN) prME-short variant CDS opt
augaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacaugugcgaugccacgaugaguuacgaguguccuauguuagacgaaggaguggagccagaugacguagauugcugguguaauaccacaagcacuuggguggucuaugguaccugccaucacaaaaagggcgaagcucgccgaucccguagagcagugacacugccgucucauucgaccaggaaacuacaaacucggucacagacauggcucgagagccgcgaguacaccaagcaccugaucagaguugaaaacuggauuuuuaggaaucccggguucgcccuugcugccgcggcaaucgccuggcuguugggaaguuccacgucucagaaagugauauaucucgucaugauccugcugauugcuccugccuacagcauccgguguauuggcguguccaaccgcgacuuuguagagggcaugucagggggaacuuggguugaugugguccucgaacaugguggcugcgugaccgugauggcacaggacaagccaacagucgauaucgaguuaguuacuaccacagugaguaauauggcugagguacgaagcuacuguuaugaagccucuauauccgacauggcgucagauagcagaugccccacccaaggggaggccuaccuggacaagcagagugacacgcaguauguguguaaaaggacucuugucgaucggggauggggcaacgguugcggguuguucggaaagggcucucuggugacaugcgcaaaauuugcuuguuccaagaaaaugaccggcaagagcauucagccugaaaaucuagaguaccguaucaugcucucgguucacgggucucaacacuccggaaugauugugaacgacacuggucaugaaacagaugagaaucgcgccaaggucgagaucaccccaaacucacccagagcugaagccacgcugggcggguucggaagucuuggccuggacugcgagccuaggaccgguuuggauuuuagcgaccucuauuaccugacaaugaauaacaaacacugguuagugcauaaggaaugguuccacgauaucccacugccguggcacgcaggggccgacacuggcacaccccauuggaauaacaaagaggcucucguagaauuuaaggaugcgcacgcaaaacggcagaccguugugguccuuggaucccaggagggcgccgugcauacugcucuggccggggcauuggaggccgaaauggacggagcuaagggucgacuaucuagcggccaccugaaaugucgccucaagauggauaagcugagacuuaaaggggucucauauagucugugcaccgccgcauucacauuuaccaagauuccugcggagacuuugcauggaacggugacaguugaagugcaguacgcuggcaccgacgguccauguaaaguacccgcccaaauggcagucgacaugcagacucucaccccuguggggaggcugauaacagccaacccaguuaucaccgaguccacugaaaauagcaagaugauguuagagcuggaucccccguucggcgacucuuacauugugaucggagucggcgagaaaaagauaacacaccacuggcaucggucagggaguacgcuaggaaaggcuuuuagcaccacucucaaaggugcccagcgccuggcagcucuuggcgauacagccugggacuucggguccauuggaggcguguucaacucuaucgguagagcgguacaccaaguguuugggggcgccuucaggaccuuguuuggaggcaugucguggaucacacaggggcugaugggagcucuccugcuuuggaugggcguuaaugcacgugaucggagcauugcccuggcuuucuuggccacuggugggguccucguguuucuggcaaccaacgugcaugcg

SEQ ID NO: 11080 - RNA, 2100 nt, Artificial Sequence; identical to SEQ ID NO: 11064
  ZIKV (strain ZikaSPH2015) ME variant CDS opt

SEQ ID NO: 11081 - RNA, 2100 nt, Artificial Sequence; identical to SEQ ID NO: 11065
  ZIKV (isolate Z1106033) ME variant CDS opt

SEQ ID NO: 11082 - RNA, 2088 nt, Artificial Sequence; identical to SEQ ID NO: 11066
  ZIKV (strain MR 766) ME variant CDS opt

SEQ ID NO: 11083 - RNA, 2100 nt, Artificial Sequence; identical to SEQ ID NO: 11067
  ZIKV (strain NatalRGN) ME variant CDS opt

SEQ ID NO: 11084 - RNA, 2073 nt, Artificial Sequence; identical to SEQ ID NO: 11068
  ZIKV (strain ZikaSPH2015) ME variant CDS opt

SEQ ID NO: 11085 - RNA, 2073 nt, Artificial Sequence; identical to SEQ ID NO: 11069
  ZIKV (isolate Z1106033) ME variant CDS opt

SEQ ID NO: 11086 - RNA, 2061 nt, Artificial Sequence; identical to SEQ ID NO: 11070
  ZIKV (strain MR 766) ME variant CDS opt

SEQ ID NO: 11087 - RNA, 2073 nt, Artificial Sequence; identical to SEQ ID NO: 11071
  ZIKV (strain NatalRGN) ME variant CDS opt

SEQ ID NO: 11088 - RNA, 2100 nt, Artificial Sequence
  ZIKV (strain ZikaSPH2015) prME-short variant CDS opt
augggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 11089 - RNA, 2100 nt, Artificial Sequence
  ZIKV (isolate Z1106033) prME-short variant CDS opt
augggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgcc

SEQ ID NO: 11090 - RNA, 2088 nt, Artificial Sequence
  ZIKV (strain MR 766) prME-short variant CDS opt
augggcagaaagcagaacaagagaggcggcaacgagggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 11091 - RNA, 2100 nt, Artificial Sequence
  ZIKV (strain NatalRGN) prME-short variant CDS opt
augggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 11092 - RNA, 2073 nt, Artificial Sequence
  ZIKV (strain ZikaSPH2015) prME-short variant CDS opt
augaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 11093 - RNA, 2073 nt, Artificial Sequence
  ZIKV (isolate Z1106033) prME-short variant CDS opt
augaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgcc

SEQ ID NO: 11094 - RNA, 2061 nt, Artificial Sequence
  ZIKV (strain MR 766) prME-short variant CDS opt
augaacgagggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 11095 - RNA, 2073 nt, Artificial Sequence
  ZIKV (strain NatalRGN) prME-short variant CDS opt
augaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 11096 - RNA, 2100 nt, Artificial Sequence
  ZIKV (strain ZikaSPH2015) prME-short variant CDS opt
augggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 11097 - RNA, 2100 nt, Artificial Sequence
  ZIKV (isolate Z1106033) prME-short variant CDS opt
augggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 11098 - RNA, 2088 nt, Artificial Sequence
  ZIKV (strain MR 766) prME-short variant CDS opt
augggcagaaagcagaacaagagaggcggcaacgagggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 11099 - RNA, 2100 nt, Artificial Sequence
  ZIKV (strain NatalRGN) prME-short variant CDS opt
augggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 11100 - RNA, 2073 nt, Artificial Sequence
  ZIKV (strain ZikaSPH2015) prME-short variant CDS opt
augaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 11101 - RNA, 2073 nt, Artificial Sequence
  ZIKV (isolate Z1106033) prME-short variant CDS opt
augaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 11102 - RNA, 2061 nt, Artificial Sequence
  ZIKV (strain MR 766) prME-short variant CDS opt
augaacgagggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 11103 - RNA, 2073 nt, Artificial Sequence
  ZIKV (strain NatalRGN) prME-short variant CDS opt
augaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 11104 - RNA, 2100 nt, Artificial Sequence; identical to SEQ ID NO: 11088
  ZIKV (strain ZikaSPH2015) ME variant CDS opt

SEQ ID NO: 11105 - RNA, 2100 nt, Artificial Sequence; identical to SEQ ID NO: 11089
  ZIKV (isolate Z1106033) ME variant CDS opt

SEQ ID NO: 11106 - RNA, 2088 nt, Artificial Sequence; identical to SEQ ID NO: 11090
  ZIKV (strain MR 766) ME variant CDS opt

SEQ ID NO: 11107 - RNA, 2100 nt, Artificial Sequence; identical to SEQ ID NO: 11091
  ZIKV (strain NatalRGN) ME variant CDS opt

SEQ ID NO: 11108 - RNA, 2073 nt, Artificial Sequence; identical to SEQ ID NO: 11092
  ZIKV (strain ZikaSPH2015) ME variant CDS opt

SEQ ID NO: 11109 - RNA, 2073 nt, Artificial Sequence; identical to SEQ ID NO: 11093
  ZIKV (isolate Z1106033) ME variant CDS opt

SEQ ID NO: 11110 - RNA, 2061 nt, Artificial Sequence; identical to SEQ ID NO: 11094
  ZIKV (strain MR 766) ME variant CDS opt

SEQ ID NO: 11111 - RNA, 2073 nt, Artificial Sequence; identical to SEQ ID NO: 11095
  ZIKV (strain NatalRGN) ME variant CDS opt

SEQ ID NO: 11112 - RNA, 2100 nt, Artificial Sequence
  ZIKV (strain ZikaSPH2015) prME-short variant CDS opt
augggcagaaagcagaacaaacggggcggaaaugagggcagcaucauguggcuggccucccucgcuguggucauugccugcgcgggggcuguuacccgcagaggaucugccuacuauauguaccuggaccggaacgaugccggcgaagcuaucagcuuccccacaacgcuugggaugaauaaguguuauauucaaaucauggaccugggacacaugugcgaugccaccauguccuacgaguguccuaugcucgacgaaggcguggagccggaugacguggauugcugguguaacacaaccucuacaugggucguguaugggaccugccaucacaaaaagggggaagcucgcagaagccggcgcgccguuacacugcccucccauucuaccagaaaacuucagacgcggagccagaccuggcuggagucccgcgaguacacaaagcaccucauuagaguggaaaauuggaucuuucggaacccuggauucgcgcuggccgcugccgcuaucgccuggcugcucggcagcucuaccucccagaaggucauuuaucuggugaugauccuucugauugcgcccgccuacagcauccgcuguauugggguuucuaauagagacuuuguggagggaauguccggcgggacaugggucgauaucgugcucgaacauggaggcugcgugaccgucauggcucaagacaaaccuacgguugauauugagcuggugacaaccacagugagcaacauggccgagguccggucuuacuguuaugaggcuuccaucagcgacauggccuccgauucucgcugccccacccagggcgaagccuaccuugacaagcagagcgacacccaguauguguguaaaagaacacugguugaucggggguggggaaauggcugcgggcuguucggaaagggcucccuggugacgugcgcuaaauuugcguguagcaagaagaugaccgggaaaucuauccaaccugaaaaccuggaguacagaauuaugcucuccguccacggaagccagcacucuggcaugaucgugaaugacacaggccaugaaaccgaugagaaccgcgccaagguugagauuacaccgaauagcccccgggcugaagccacccucgggggauucggcucccuugggcuggacugcgagccuagaacgggacucgauuuuucugaccuguauuaccuuacaaugaacaauaaacacuggcuggugcauaaggaaugguuccacgauaucccccucccuuggcacgccggcgcugacaccgggacaccccauuggaacaacaaagaggcccuggucgaauuuaaggaugcgcacgcuaaacgccagaccguggucgugcugggcagccaggagggagccguucauaccgcccucgcuggcgcccuggaggcugaaauggacggggccaagggacggcuuuccagcggccaccugaaguguagacucaaaauggauaagcugcgccuuaaaggggugucuuauucccugugcacagcggccuucacguuuaccaagauuccggcugagacacuccauggaaccgucacaguggaaguucaauacgccggcaccgacgggccuuguaaagugcccgcucagauggccgucgacaugcagacgcugaccccugugggccggcugaucacagcgaaucccgugaucaccgagagcacagaaaacucuaagaugaugcucgagcuggaucccccuuucggagacuccuacauuguuaucggcgucggggagaagaaaauuacccaccacuggcauagaagcggauccacgaucggcaaggccuuugaagcuacagugcgcggggccaaacggauggcugugcuuggagauaccgccugggacuucggcucugucgggggcgcccugaauagccucggaaagggcauucaccaaaucuucggggcugcguuuaaaucccuguucggaggcaugucuugguuuagccagauccugauugggacacuucucauguggcugggacugaacaccaagaauggcuccaucagccucaugugccuggcccuugggggcgugcugauuuuccucucuaccgcuguuuccgcc

SEQ ID NO: 11113 - RNA, 2100 nt, Artificial Sequence
  ZIKV (isolate Z1106033) prME-short variant CDS opt
augggcagaaagcagaacaaacgcgggggaaaugagggcagcaucauguggcuggccucccucgcuguggucauugccugcgcgggggcuguuacccggagaggaucugccuacuauauguaccuggaccggaacgaugccggcgaagcuaucagcuuccccacaacgcuugggaugaauaaguguuauauucaaaucauggaccugggacauaccugcgaugccacaauguccuacgaguguccuaugcucgacgaaggcguggagccggaugacguggauugcugguguaacaccacaucuaccugggucguguauggcacaugccaccacaaaaagggggaagcucgcagaagccggcgcgccguuacccugcccucccauucuacgagaaaacuucagacccggagccagacauggcuggagucccgcgaguacaccaagcaccucauuagaguggaaaauuggaucuuucggaacccuggauucgcgcuggccgcugccgcuaucgccuggcugcucggcagcucuacaucccagaaggucauuuaucuggugaugauccuucugauugcgcccgccuacagcauccgcuguauugggguuucuaauagagacuuuguggagggaauguccggcgggaccugggucgauguggugcucgaacauggaggcugcgucacgguuauggcucaagacaaaccuacaguggauaucgagcuggugaccacaaccgucagcaacauggccgaggugcggucuuacuguuaugaggcuuccauuagcgacauggccuccgauucucgcugccccacccagggcgaagccuaccuugacaagcagagcgacacacaguauguuuguaaaagaacgcugguggaucggggguggggaaauggcugcgggcuguucggaaagggcucccuggugaccugcgcuaaauuugcguguagcaagaagaugacagggaaaucuauccaaccugaaaaccuggaguacagaaucaugcucuccgugcacggaagccagcacucuggcaugauuguuaaugacaccggccaugaaacagaugagaaccgcgccaagguggagaucaccccgaauagcccccgggcugaagccacgcucgggggauucggcucccuugggcuggacugcgagccuagaacaggacucgauuuuucugaccuguauuaccuuaccaugaacaauaaacacuggcugguccauaaggaaugguuccacgauauuccccucccuuggcacgccggcgcugacaccgggacaccccauuggaacaacaaagaggcccugguggaauuuaaggaugcgcacgcuaaacgccagaccgucgugguucugggcagccaggagggagccgugcauacagcccucgcuggcgcccuggaggcugaaauggacggggccaagggacggcuuuccagcggccaccugaaguguagacucaaaauggauaagcugcgccuuaaaggggucucuuauucccugugcacggcggccuucaccuuuacaaagaucccggcugagacccuccauggaacagugaccguugaagugcaauacgccggcacggacgggccuuguaaaguccccgcucagauggccguggacaugcagacccugacaccugugggccggcugauuaccgcgaaucccguuaucacagagagcaccgaaaacucuaagaugaugcucgagcuggaucccccuuucggagacuccuacaucgucauuggcgugggggagaagaaaaucacgcaccacuggcauagaagcggauccacaauuggcaaggccuuugaagcuaccgugcgcggggccaaacggauggcuguccuuggagauacagccugggacuucggcucugucgggggcgcccugaauagccucggaaagggcauccaccaaauuuucggggcugcguuuaaaucccuguucggaggcaugucuugguuuagccagauccugaucgggacccuucucauguggcugggacugaacgccaagaauggcuccauuagccucaugugccuggcucuugggggcguucugaucuuccucucuaccgccguguccgcc

SEQ ID NO: 11114 - RNA, 2088 nt, Artificial Sequence
  ZIKV (strain MR 766) prME-short variant CDS opt
augggcagaaagcagaacaaacggggcggaaaugagggcagcaucauguggcuggccucccucgcuguggucauugccugcgcgggggcuaucacccgcagaggaucugccuacuauauguaccuggaccggagcgaugccggcaaggcuauuuccuucgccacaacgcuugggguuaacaaaugucacgugcaaaucauggaccugggacauaugugcgaugcuaccaugucuuaugaaugucccaugcucgacgagggcguggaacccgaugacgucgauugcugguguaauacaaccagcacaugggugguuuacgggaccugccaccauaagaaaggggaggcccgcagaucccggcgcgcggugacacugccgucucacagcaccagaaagcugcagacgcggucccagaccuggcuggaaagccgcgaguauacaaagcaucucauuaaagucgagaacuggaucuuuagaaaucccggauucgcccugguggcuguugccaucgcuuggcugcucgggucuuccaccagccagaaggugauuuaccuggucaugauccuucugauugccccugcguauucuauccgguguauugggguguccaaccgcgacuuuguggaaggaaugagcggcgggacaugggucgauguugugcucgagcacggaggcugcgugaccgucauggcccaagacaaacccacgguggauaucgaacugguuacaaccacagugucuaauauggcugaggucagauccuacuguuacgaggccagcauuuccgacauggcuucugauagccggugcccuacccagggcgaagccuaucuugacaagcaguccgacacccaguacguguguaaacgcacacugguugauagaggguggggaaacggcugcggccucuucggaaagggcagccuggugacgugcgccaaguuuaccuguucuaaaaagaugacagggaaauccauccaacccgagaaucuggaauaucggaucaugcucagcguccacggaucucagcauagcggcaugauuggcuacgagaccgacgaagauagagcuaagguggaggucacaccuaacuccccgcgcgcggaggccacccuugggggauucggcucucuugggcuggacugcgaaccccggacgggacucgauuuuagcgaccuguauuaccuuacaaugaauaacaaacacuggcuggugcauaaggagugguuccacgauaucccucuccccuggcacgcuggcgccgacaccgggaccccucauuggaauaacaaagaagcccugguugaguuuaaggaugcucacgccaagagacagacaguggucgugcugggcucccaggaaggagcgguucauaccgcucucgccggcgcccuggaggcugagauggacggggccaaaggacgccuuuucagcggccaccugaagugucggcucaaaauggauaagcugagacuuaaaggggugucuuauucccugugcacagcugccuuuacguucaccaagguccccgcggaaacacuccauggaaccgugacaguggagguucaauacgccggcaccgacgggccguguaagauuccuguccagauggcuguggacaugcagacgcugacccccgugggccgccugaucacagccaauccugucauuaccgaaagcacagagaacucuaaaaugaugcucgaacuggauccucccuuuggagacuccuacaucgugaucggcguuggggauaagaaaauuacccaccacuggcaucggagcggauccacgaucggcaaggcuuucgaggccacagugagaggggcgaaacgcauggccguccuuggagacaccgcuugggauuucggcucuguugggggcguguuuaacagccugggaaagggcauucaccaaaucuucggggccgcuuuuaagucccucuucggaggcaugucuugguuuagccagauucugaucgggacacugcuuguguggcucggacugaauaccaaaaacggcuccaucagccugaccugccucgcccuugggggcgucaugauuuuccugucuacagccguguccgcu

SEQ ID NO: 11115 - RNA, 2100 nt, Artificial Sequence
  ZIKV (strain NatalRGN) prME-short variant CDS opt
augggcagaaagcagaacaaacggggcggaaaugagggcagcaucauguggcuggccucccucgcuguggucauugccugcgcgggggcuguuacccgcagaggaucugccuacuauauguaccuggaccggaacgaugccggcgaagcuaucagcuuccccacaacgcuugggaugaauaaguguuauauucaaaucauggaccugggacacaugugcgaugccaccauguccuacgaguguccuaugcucgacgaaggcguggagccggaugacguggauugcugguguaacacaaccucuacaugggucguguaugggaccugccaucacaaaaagggggaagcucgcagaagccggcgcgccguuacacugcccucccauucuaccagaaaacuucagacgcggagccagaccuggcuggagucccgcgaguacacaaagcaccucauuagaguggaaaauuggaucuuucggaacccuggauucgcgcuggccgcugccgcuaucgccuggcugcucggcagcucuaccucccagaaggucauuuaucuggugaugauccuucugauugcgcccgccuacagcauccgcuguauugggguuucuaauagagacuuuguggagggaauguccggcgggacaugggucgauguggugcucgaacauggaggcugcgucaccguuauggcucaagacaaaccuacgguggauaucgagcuggugacaaccacagucagcaacauggccgaggugcggucuuacuguuaugaggcuuccauuagcgacauggccuccgauucucgcugccccacccagggcgaagccuaccuugacaagcagagcgacacccaguauguuuguaaaagaacacugguggaucggggguggggaaauggcugcgggcuguucggaaagggcucccuggucacgugcgcuaaauuugcguguagcaagaagaugaccgggaaaucuauccaaccugaaaaccuggaguacagaaucaugcucuccgugcacggaagccagcacucuggcaugauuguuaaugacacaggccaugaaaccgaugagaaccgcgccaagguggagaucacaccgaauagcccccgggcugaagccacccucgggggauucggcucccuugggcuggacugcgagccuagaacgggacucgauuuuucugaccuguauuaccuuacaaugaacaauaaacacuggcugguccauaaggaaugguuccacgauauuccccucccuuggcacgccggcgcugacaccgggacaccccauuggaacaacaaagaggcccugguggaauuuaaggaugcgcacgcuaaacgccagaccgucgugguucugggcagccaggagggagccgugcauaccgcccucgcuggcgcccuggaggcugaaauggacggggccaagggacggcuuuccagcggccaccugaaguguagacucaaaauggauaagcugcgccuuaaaggggucucuuauucccugugcacagcggccuucacguuuaccaagaucccggcugagacacuccauggaaccgugacaguugaagugcaauacgccggcaccgacgggccuuguaaaguccccgcucagauggccguggacaugcagacgcugaccccugugggccggcugauuacagcgaaucccguuaucaccgagagcacagaaaacucuaagaugaugcucgagcuggaucccccuuucggagacuccuacaucgucauuggcgugggggagaagaaaaucacccaccacuggcauagaagcggauccacgauuggcaaggccuuugaagcuacagugcgcggggccaaacggauggcuguccuuggagauaccgccugggacuucggcucuguugggggcgcccugaauagccucggaaagggcauccaccaaauuuucggggcugcguuuaaaucccuguucggaggcaugucuugguuuagccagauccugaucgggacacuucucauguggcugggacugaacaccaagaauggcuccauuagccucaugugccuggcccuugggggcgugcugaucuuccucucuaccgcuguguccgcc

SEQ ID NO: 11116 - RNA, 2073 nt, Artificial Sequence
  ZIKV (strain ZikaSPH2015) prME-short variant CDS opt
augaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacacaugugcgaugccaccauguccuacgaguguccuaugcucgacgaaggcguggagccggaugacguggauugcugguguaauacaaccucuacaugggucguguaugggaccugccaucacaaaaagggagaagcuagacggagccgcagagccguuacacugcccucccauucuacccggaaacuucaaacgcgcagccagaccuggcuggaguccagagaguacacaaagcaccucauucggguggaaaacuggaucuuucgcaauccuggcuucgcgcuggccgcugccgcuaucgccuggcugcucggcagcucuaccucccagaaagucauuuaucuggugaugauccuucugauugcgcccgccuacagcaucagauguauugggguuucuaaccgggacuuuguggagggaauguccggcgggacaugggucgauaucgugcucgaacauggaggcugcgugaccgucauggcucaggacaagccuacgguugauauugagcuggugacaaccacagugagcaauauggccgagguccgcucuuacuguuaugaggcuuccaucagcgacauggccuccgauucuagaugccccacccaaggggaagccuaccuugacaagcagagcgacacccaguauguguguaaacggacacugguugaucgcggauggggcaacggcugcggacucuucgggaagggcucccuggugacgugcgcuaaauuugcguguagcaagaaaaugaccgggaagucuauccagccugaaaaucuggaguacagaauuaugcucuccguccacggaagccaacacucuggcaugaucgugaacgacacagggcaugaaaccgaugagaaucgggccaagguugagauuacaccgaacagccccagagcugaagccacccugggaggcuucggcucccuugggcuggacugcgagccucgcacgggacucgauuuuucugaccuguauuaccuuacaaugaauaacaaacacuggcuggugcauaaggaaugguuccacgauaucccccucccuuggcacgccggcgcugacaccgggacaccccauuggaauaacaaagaggcccuggucgaauuuaaggaugcgcacgcuaaacggcagaccguggucgugcugggaagccaggagggcgccguucauaccgcccucgcuggggcccuggaggcugaaauggacggcgccaagggaagacuuuccagcggccaccugaaaugucgccucaagauggauaagcugcggcuuaaaggggugucuuauucccugugcacagcggccuucacguuuaccaagauuccggcugagacacuccauggaaccgucacaguggaaguucaguacgccggcaccgacgggccuuguaaagugcccgcucaaauggccgucgacaugcagacgcugaccccugugggaagacugaucacagcgaaccccgugaucaccgagagcacagaaaauucuaagaugaugcucgagcuggaucccccuuucggcgacuccuacauuguuaucggggucggcgagaaaaagauuacccaccacuggcaucgcagcggauccacgaucggcaaggccuuugaagcuacagugagaggggccaaacggauggcugugcuuggagauaccgccugggacuucggcucugucgggggagcccugaacagccucggcaaggggauucaccagaucuucggcgcugcguuuaaaucccuguucggaggcaugucuugguuuagccaaauccugauugggacacuucucauguggcugggacugaauaccaagaacggcuccaucagccucaugugccuggcccuugggggagugcugauuuuccucucuaccgcuguuuccgcc

SEQ ID NO: 11117 - RNA, 2073 nt, Artificial Sequence
  ZIKV (isolate Z1106033) prME-short variant CDS opt
augaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacauaccugcgaugccacaauguccuacgaguguccuaugcucgacgaaggcguggagccggaugacguggauugcugguguaauaccacaucuaccugggucguguaugggacaugccaccacaaaaagggagaagcuagacggagccgcagagccguuacccugcccucccauucuacgcggaaacuucaaacccgcagccagacauggcuggaguccagagaguacaccaagcaccucauucggguggaaaacuggaucuuucgcaauccuggcuucgcgcuggccgcugccgcuaucgccuggcugcucggcagcucuacaucccagaaagucauuuaucuggugaugauccuucugauugcgcccgccuacagcaucagauguauugggguuucuaaccgggacuuuguggagggaauguccggcgggaccugggucgauguggugcucgaacauggaggcugcgucacgguuauggcucaggacaagccuacaguggauaucgagcuggugaccacaaccgucagcaauauggccgaggugcgcucuuacuguuaugaggcuuccauuagcgacauggccuccgauucuagaugccccacccaaggggaagccuaccuugacaagcagagcgacacacaguauguuuguaaacggacgcugguggaucgcggauggggcaacggcugcggacucuucgggaagggcucccuggugaccugcgcuaaauuugcguguagcaagaaaaugacagggaagucuauccagccugaaaaucuggaguacagaaucaugcucuccgugcacggaagccaacacucuggcaugauuguuaacgacaccgggcaugaaacagaugagaaucgggccaagguggagaucaccccgaacagccccagagcugaagccacgcugggaggcuucggcucccuugggcuggacugcgagccucgcacaggacucgauuuuucugaccuguauuaccuuaccaugaauaacaaacacuggcugguccauaaggaaugguuccacgauauuccccucccuuggcacgccggcgcugacaccgggacaccccauuggaauaacaaagaggcccugguggaauuuaaggaugcgcacgcuaaacggcagaccgucgugguucugggaagccaggagggcgccgugcauacagcccucgcuggggcccuggaggcugaaauggacggcgccaagggaagacuuuccagcggccaccugaaaugucgccucaagauggauaagcugcggcuuaaaggggucucuuauucccugugcacggcggccuucaccuuuacaaagaucccggcugagacccuccauggaacagugaccguugaagugcaguacgccggcacggacgggccuuguaaaguccccgcucaaauggccguggacaugcagacccugacaccugugggaagacugauuaccgcgaaccccguuaucacagagagcaccgaaaauucuaagaugaugcucgagcuggaucccccuuucggcgacuccuacaucgucauuggggugggcgagaaaaagaucacgcaccacuggcaucgcagcggauccacaauuggcaaggccuuugaagcuaccgugagaggggccaaacggauggcuguccuuggagauacagccugggacuucggcucugucgggggagcccugaacagccucggcaaggggauccaccagauuuucggcgcugcguuuaaaucccuguucggaggcaugucuugguuuagccaaauccugaucgggacccuucucauguggcugggacugaaugccaagaacggcuccauuagccucaugugccuggcucuugggggaguucugaucuuccucucuaccgccguguccgcc

SEQ ID NO: 11118 - RNA, 2061 nt, Artificial Sequence
  ZIKV (strain MR 766) prME-short variant CDS opt
augaacgagggcagcaucauguggcuggccucccucgcuguggucauugccugcgcgggggcuaucaccagacggggaucugccuacuauauguaccuggaccgcagcgaugccggcaaggcuauuuccuucgccacaacgcuugggguuaauaaaugucacgugcagaucauggaccugggacauaugugcgaugcuaccaugucuuaugaaugucccaugcucgacgagggcguggaacccgaugacgucgauugcugguguaacacaaccagcacaugggugguuuacgggaccugccaccauaagaaaggagaggccagacggucccgcagagcggugacacugccgucucacagcacccggaagcugcaaacgcgcucccagaccuggcuggaaagcagagaguauacaaaacaucucauuaaggucgagaauuggaucuuucggaaccccggcuucgcccugguggcuguugccaucgcuuggcugcucgggucuuccaccagccagaaggugauuuaccuggucaugauccuucugauugccccugcguauucuauccgcuguauugggguguccaauagagacuuuguggaaggaaugagcggcgggacaugggucgauguugugcucgagcacggaggcugcgugaccgucauggcccaggacaaacccacgguggauaucgaacugguuacaaccacagugucuaacauggcugagguccgguccuacuguuacgaggccagcauuuccgacauggcuucugauagccgcugcccuacccaaggggaagccuaucuugacaagcaguccgacacccaguacguguguaaaagaacacugguugaucggggauggggcaauggcugcggccucuucggaaagggcagccuggugacgugcgccaaauuuaccuguucuaagaagaugacagggaaauccauccagcccgagaaccuggaauaucgcaucaugcucagcguccacggaucucaacauagcggcaugauuggguacgagaccgacgaagauagagcuaagguggaggucacaccuaauuccccgcgggcggaggccacccugggaggcuucggcucucuugggcuggacugcgaacccagaacgggacucgauuuuagcgaccuguauuaccuuacaaugaacaauaaacacuggcuggugcauaaggagugguuccacgauaucccucuccccuggcacgcuggcgccgacaccgggaccccucauuggaacaauaaagaagcccugguugaguuuaaggaugcucacgccaaacgccagacaguggucgugcugggaucccaggaaggcgcgguucauaccgcucucgccggggcccuggaggcugagauggacggcgccaagggacggcuuuucagcggccaccugaaguguagacucaaaauggauaagcugcgccuuaaaggggugucuuauucccugugcacagcugccuuuacguucaccaagguccccgcggaaacacuccauggaaccgugacaguggagguucaguacgccggcaccgacgggccguguaaaauuccuguccaaauggcuguggacaugcagacgcugacccccgugggacggcugaucacagccaacccugucauuaccgaaagcacagaaaauucuaagaugaugcucgagcuggauccucccuuuggcgacuccuacaucgugaucgggguuggcgauaagaaaauuacccaccacuggcauagaagcggauccacgaucggcaaggcuuucgaggccacagugcgcggggcgaaacggauggccguccuuggagacaccgcuugggauuucggcucuguugggggaguguuuaacagccugggcaaggggauucaccagaucuucggcgccgcuuuuaaaucccucuucggaggcaugucuugguuuagccaaauucugaucgggacacugcuuguguggcucggacugaacaccaagaauggcuccaucagccugaccugccucgcccuugggggagucaugauuuuccuuucuacagccguguccgcu

SEQ ID NO: 11119 - RNA, 2073 nt, Artificial Sequence
  ZIKV (strain NatalRGN) prME-short variant CDS opt
augaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacacaugugcgaugccaccauguccuacgaguguccuaugcucgacgaaggcguggagccggaugacguggauugcugguguaauacaaccucuacaugggucguguaugggaccugccaucacaaaaagggagaagcuagacggagccgcagagccguuacacugcccucccauucuacccggaaacuucaaacgcgcagccagaccuggcuggaguccagagaguacacaaagcaccucauucggguggaaaacuggaucuuucgcaauccuggcuucgcgcuggccgcugccgcuaucgccuggcugcucggcagcucuaccucccagaaagucauuuaucuggugaugauccuucugauugcgcccgccuacagcaucagauguauugggguuucuaaccgggacuuuguggagggaauguccggcgggacaugggucgauguggugcucgaacauggaggcugcgucaccguuauggcucaggacaagccuacgguggauaucgagcuggugacaaccacagucagcaauauggccgaggugcgcucuuacuguuaugaggcuuccauuagcgacauggccuccgauucuagaugccccacccaaggggaagccuaccuugacaagcagagcgacacccaguauguuuguaaacggacacugguggaucgcggauggggcaacggcugcggacucuucgggaagggcucccuggucacgugcgcuaaauuugcguguagcaagaaaaugaccgggaagucuauccagccugaaaaucuggaguacagaaucaugcucuccgugcacggaagccaacacucuggcaugauuguuaacgacacagggcaugaaaccgaugagaaucgggccaagguggagaucacaccgaacagccccagagcugaagccacccugggaggcuucggcucccuugggcuggacugcgagccucgcacgggacucgauuuuucugaccuguauuaccuuacaaugaauaacaaacacuggcugguccauaaggaaugguuccacgauauuccccucccuuggcacgccggcgcugacaccgggacaccccauuggaauaacaaagaggcccugguggaauuuaaggaugcgcacgcuaaacggcagaccgucgugguucugggaagccaggagggcgccgugcauaccgcccucgcuggggcccuggaggcugaaauggacggcgccaagggaagacuuuccagcggccaccugaaaugucgccucaagauggauaagcugcggcuuaaaggggucucuuauucccugugcacagcggccuucacguuuaccaagaucccggcugagacacuccauggaaccgugacaguugaagugcaguacgccggcaccgacgggccuuguaaaguccccgcucaaauggccguggacaugcagacgcugaccccugugggaagacugauuacagcgaaccccguuaucaccgagagcacagaaaauucuaagaugaugcucgagcuggaucccccuuucggcgacuccuacaucgucauuggggugggcgagaaaaagaucacccaccacuggcaucgcagcggauccacgauuggcaaggccuuugaagcuacagugagaggggccaaacggauggcuguccuuggagauaccgccugggacuucggcucuguugggggagcccugaacagccucggcaaggggauccaccagauuuucggcgcugcguuuaaaucccuguucggaggcaugucuugguuuagccaaauccugaucgggacacuucucauguggcugggacugaauaccaagaacggcuccauuagccucaugugccuggcccuugggggagugcugaucuuccucucuaccgcuguguccgcc

SEQ ID NO: 11120 - RNA, 2100 nt, Artificial Sequence
  ZIKV (strain ZikaSPH2015) prME-short variant CDS opt
augggcagaaagcagaacaaacggggcggaaaugagggcagcaucauguggcuggccucccucgcuguggucauugccugcgcgggggcuguuacccgcagaggaucugccuacuauauguaccuggaccggaacgaugccggcgaagcuaucagcuuccccacaacgcuugggaugaauaaguguuauauucaaaucauggaccugggacacaugugcgaugccaccauguccuacgaguguccuaugcucgacgaaggcguggagccggaugacguggauugcugguguaacacaaccucuacaugggucguguaugggaccugccaucacaaaaagggggaagcucgcagaagccggcgcgccguuacacugcccucccauucuaccagaaaacuucagacgcggagccagaccuggcuggagucccgcgaguacacaaagcaccucauuagaguggaaaauuggaucuuucggaacccuggauucgcgcuggccgcugccgcuaucgccuggcugcucggcagcucuaccucccagaaggucauuuaucuggugaugauccuucugauugcgcccgccuacagcauccgcuguauugggguuucuaauagagacuuuguggagggaauguccggcgggacaugggucgauaucgugcucgaacauggaggcugcgugaccgucauggcucaagacaaaccuacgguugauauugagcuggugacaaccacagugagcaacauggccgagguccggucuuacuguuaugaggcuuccaucagcgacauggccuccgauucucgcugccccacccagggcgaagccuaccuugacaagcagagcgacacccaguauguguguaaaagaacacugguugaucggggguggggaaauggcugcgggcuguucggaaagggcucccuggugacgugcgcuaaauuugcguguagcaagaagaugaccgggaaaucuauccaaccugaaaaccuggaguacagaauuaugcucuccguccacggaagccagcacucuggcaugaucgugaaugacacaggccaugaaaccgaugagaaccgcgccaagguugagauuacaccgaauagcccccgggcugaagccacccucgggggauucggcucccuugggcuggacugcgagccuagaacgggacucgauuuuucugaccuguauuaccuuacaaugaacaauaaacacuggcuggugcauaaggaaugguuccacgauaucccccucccuuggcacgccggcgcugacaccgggacaccccauuggaacaacaaagaggcccuggucgaauuuaaggaugcgcacgcuaaacgccagaccguggucgugcugggcagccaggagggagccguucauaccgcccucgcuggcgcccuggaggcugaaauggacggggccaagggacggcuuuccagcggccaccugaaguguagacucaaaauggauaagcugcgccuuaaaggggugucuuauucccugugcacagcggccuucacguuuaccaagauuccggcugagacacuccauggaaccgucacaguggaaguucaauacgccggcaccgacgggccuuguaaagugcccgcucagauggccgucgacaugcagacgcugaccccugugggccggcugaucacagcgaaucccgugaucaccgagagcacagaaaacucuaagaugaugcucgagcuggaucccccuuucggagacuccuacauuguuaucggcgucggggagaagaaaauuacccaccacuggcauagaagcggauccacgcuuggcaaggccuuuucuacaacccugaaaggggcucaacgccucgccgcucugggagauacagccugggacuucggcagcaucgggggcguguucaauuccauuggacgggccgugcaccaggucuuuggcggggcuuucagaacccuguuuggaggcaugucuuggaucacccaggggcuuaugggagcgcuccugcuguggaugggcgugaacgcccgcgaucggagcaucgcucucgccuuccuggccacagggggcguucuuguguuucuggcuacgaauguccaugcc

SEQ ID NO: 11121 - RNA, 2100 nt, Artificial Sequence
  ZIKV (isolate Z1106033) prME-short variant CDS opt
augggcagaaagcagaacaaacgcgggggaaaugagggcagcaucauguggcuggccucccucgcuguggucauugccugcgcgggggcuguuacccggagaggaucugccuacuauauguaccuggaccggaacgaugccggcgaagcuaucagcuuccccacaacgcuugggaugaauaaguguuauauucaaaucauggaccugggacacacgugcgaugccacaauguccuacgaguguccuaugcucgacgaaggcguggagccggaugacguggauugcugguguaacaccacaucuaccugggucguguauggcacaugccaucacaaaaagggggaagcucgcagaagccggcgcgccguuacccugcccucccauucuacgagaaaacuucagacccggagccagacauggcuggagucccgcgaguacaccaagcaccucauuagaguggaaaauuggaucuuucggaacccuggauucgcgcuggccgcugccgcuaucgccuggcugcucggcagcucuacaucccagaaggucauuuaucuggugaugauccuucugauugcgcccgccuacagcauccgcuguauugggguuucuaauagagacuuuguggagggaauguccggcgggaccugggucgauguggugcucgaacauggaggcugcgucacgguuauggcucaagacaaaccuacaguggauaucgagcuggugaccacaaccgucagcaacauggccgaggugcggucuuacuguuaugaggcuuccauuagcgacauggccuccgauucucgcugccccacccagggcgaagccuaccuugacaagcagagcgacacacaguauguuuguaaaagaacgcugguggaucggggguggggaaauggcugcgggcuguucggaaagggcucccuggugaccugcgcuaaauuugcguguagcaagaagaugacagggaaaucuauccaaccugaaaaccuggaguacagaaucaugcucuccguccacggaagccagcacucuggcaugauuguuaaugacaccggccaugaaacagaugagaaccgcgccaagguggagaucaccccgaauagcccccgggcugaagccacgcucgggggauucggcucccuugggcuggacugcgagccuagaacaggacucgauuuuucugaccuguauuaccuuaccaugaacaauaaacacuggcugguccauaaggaaugguuccacgauauuccccucccuuggcacgccggcgcugacaccgggacaccccauuggaacaacaaagaggcccugguggaauuuaaggaugcgcacgcuaaacgccagaccgucgugguucugggcagccaggagggagccgugcauacagcccucgcuggcgcccuggaggcugaaauggacggggccaagggacggcuuuccagcggccaccugaaguguagacucaaaauggauaagcugcgccuuaaaggggucucuuauucccugugcacggcggccuucaccuuuacaaagaucccggcugagacccuccauggaacagugaccguugaagugcaauacgccggcacggacgggccuuguaaaguccccgcucagauggccguggacaugcagacccugacaccugugggccggcugauuaccgcgaaucccguuaucacagagagcaccgaaaacucuaagaugaugcucgagcuggaucccccuuucggagacuccuacaucgucauuggcgugggggagaagaaaaucacgcaccacuggcauagaagcggauccacacuuggcaaggccuuuucuaccacacugaaaggggcucaacgccucgccgcucugggagauaccgccugggacuucggcagcauugggggcguguucaauuccaucggacgggccguccaccagguguuuggcggggcuuucagaacccuguuuggaggcaugucuuggauuacacaggggcuuaugggagcgcuccugcuguggaugggcguuaacgcccgcgaucggagcaucgcucucgccuuccuggccaccgggggcgugcuugucuuucuggcuaccaaugugcaugcc

SEQ ID NO: 11122 - RNA, 2088 nt, Artificial Sequence
  ZIKV (strain MR 766) prME-short variant CDS opt
augggcagaaagcagaacaaacggggcggaaaugagggcagcaucauguggcuggccucccucgcuguggucauugccugcgcgggggcuaucacccgcagaggaucugccuacuauauguaccuggaccggagcgaugccggcaaggcuauuuccuucgccacaacgcuugggguuaacaaaugucacgugcaaaucauggaccugggacauaugugcgaugcuaccaugucuuaugaaugucccaugcucgacgagggcguggaacccgaugacgucgauugcugguguaauacaaccagcacaugggugguuuacgggaccugccaccauaagaaaggggaggcccgcagaucccggcgcgcggugacacugccgucucacagcaccagaaagcugcagacgcggucccagaccuggcuggaaagccgcgaguauacaaagcaucucauuaaagucgagaacuggaucuuuagaaaucccggauucgcccugguggcuguugccaucgcuuggcugcucgggucuuccaccagccagaaggugauuuaccuggucaugauccuucugauugccccugcguauucuauccgguguauugggguguccaaccgcgacuuuguggaaggaaugagcggcgggacaugggucgauguugugcucgagcacggaggcugcgugaccgucauggcccaagacaaacccacgguggauaucgaacugguuacaaccacagugucuaauauggcugaggucagauccuacuguuacgaggccagcauuuccgacauggcuucugauagccggugcccuacccagggcgaagccuaucuugacaagcaguccgacacccaguacguguguaaacgcacacugguugauagaggguggggaaacggcugcggccucuucggaaagggcagccuggugacgugcgccaaguuuaccuguucuaaaaagaugacagggaaauccauccaacccgagaaucuggaauaucggaucaugcucagcguccacggaucucagcauagcggcaugauuggcuacgagaccgacgaagauagagcuaagguggaggucacaccuaacuccccgcgcgcggaggccacccuugggggauucggcucucuugggcuggacugcgaaccccggacgggacucgauuuuagcgaccuguauuaccuuacaaugaauaacaaacacuggcuggugcauaaggagugguuccacgauaucccucuccccuggcacgcuggcgccgacaccgggaccccucauuggaauaacaaagaagcccugguugaguuuaaggaugcucacgccaagagacagacaguggucgugcugggcucccaggaaggagcgguucauaccgcucucgccggcgcccuggaggcugagauggacggggccaaaggacgccuuuucagcggccaccugaagugucggcucaaaauggauaagcugagacuuaaaggggugucuuauucccugugcacagcugccuuuacguucaccaagguccccgcggaaacacuccauggaaccgugacaguggagguucaauacgccggcaccgacgggccguguaagauuccuguccagauggcuguggacaugcagacgcugacccccgugggccgccugaucacagccaauccugucauuaccgaaagcacagagaacucuaaaaugaugcucgaacuggauccucccuuuggagacuccuacaucgugaucggcguuggggauaagaaaauuacccaccacuggcaucggagcggauccacgcuuggcaaggcuuucucuacaacccugaaaggggcccaaagacucgcggcccugggagacacagcuugggauuucggcagcaucgggggcguguuuaacuccauuggacgcgccguccaccagguguucggcggggcuuuucggacccuguucggaggcaugucuuggaucacccaggggcuuaugggagcccuccugcuguggaugggcguuaaugccagagaccgcagcauugcucucgcguuucuggccacagggggcgugcuugucuuccuggcuacgaacgugcaugcc

SEQ ID NO: 11123 - RNA, 2100 nt, Artificial Sequence
  ZIKV (strain NatalRGN) prME-short variant CDS opt
augggcagaaagcagaacaaacggggcggaaaugagggcagcaucauguggcuggccucccucgcuguggucauugccugcgcgggggcuguuacccgcagaggaucugccuacuauauguaccuggaccggaacgaugccggcgaagcuaucagcuuccccacaacgcuugggaugaauaaguguuauauucaaaucauggaccugggacacaugugcgaugccaccauguccuacgaguguccuaugcucgacgaaggcguggagccggaugacguggauugcugguguaacacaaccucuacaugggucguguaugggaccugccaucacaaaaagggggaagcucgcagaagccggcgcgccguuacacugcccucccauucuaccagaaaacuucagacgcggagccagaccuggcuggagucccgcgaguacacaaagcaccucauuagaguggaaaauuggaucuuucggaacccuggauucgcgcuggccgcugccgcuaucgccuggcugcucggcagcucuaccucccagaaggucauuuaucuggugaugauccuucugauugcgcccgccuacagcauccgcuguauugggguuucuaauagagacuuuguggagggaauguccggcgggacaugggucgauguggugcucgaacauggaggcugcgucaccguuauggcucaagacaaaccuacgguggauaucgagcuggugacaaccacagucagcaacauggccgaggugcggucuuacuguuaugaggcuuccauuagcgacauggccuccgauucucgcugccccacccagggcgaagccuaccuugacaagcagagcgacacccaguauguuuguaaaagaacacugguggaucggggguggggaaauggcugcgggcuguucggaaagggcucccuggucacgugcgcuaaauuugcguguagcaagaagaugaccgggaaaucuauccaaccugaaaaccuggaguacagaaucaugcucuccgugcacggaagccagcacucuggcaugauuguuaaugacacaggccaugaaaccgaugagaaccgcgccaagguggagaucacaccgaauagcccccgggcugaagccacccucgggggauucggcucccuugggcuggacugcgagccuagaacgggacucgauuuuucugaccuguauuaccuuacaaugaacaauaaacacuggcugguccauaaggaaugguuccacgauauuccccucccuuggcacgccggcgcugacaccgggacaccccauuggaacaacaaagaggcccugguggaauuuaaggaugcgcacgcuaaacgccagaccgucgugguucugggcagccaggagggagccgugcauaccgcccucgcuggcgcccuggaggcugaaauggacggggccaagggacggcuuuccagcggccaccugaaguguagacucaaaauggauaagcugcgccuuaaaggggucucuuauucccugugcacagcggccuucacguuuaccaagaucccggcugagacacuccauggaaccgugacaguugaagugcaauacgccggcaccgacgggccuuguaaaguccccgcucagauggccguggacaugcagacgcugaccccugugggccggcugauuacagcgaaucccguuaucaccgagagcacagaaaacucuaagaugaugcucgagcuggaucccccuuucggagacuccuacaucgucauuggcgugggggagaagaaaaucacccaccacuggcauagaagcggauccacgcuuggcaaggccuuuucuacaacccugaaaggggcucaacgccucgccgcucugggagauacagccugggacuucggcagcauugggggcguguucaauuccaucggacgggccguccaccagguguuuggcggggcuuucagaacccuguuuggaggcaugucuuggauuacccaggggcuuaugggagcgcuccugcuguggaugggcguuaacgcccgcgaucggagcaucgcucucgccuuccuggccacagggggcgugcuugucuuucuggcuacgaaugugcaugcc

SEQ ID NO: 11124 - RNA, 2073 nt, Artificial Sequence
  ZIKV (strain ZikaSPH2015) prME-short variant CDS opt
augaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacacaugugcgaugccaccauguccuacgaguguccuaugcucgacgaaggcguggagccggaugacguggauugcugguguaauacaaccucuacaugggucguguaugggaccugccaucacaaaaagggagaagcuagacggagccgcagagccguuacacugcccucccauucuacccggaaacuucaaacgcgcagccagaccuggcuggaguccagagaguacacaaagcaccucauucggguggaaaacuggaucuuucgcaauccuggcuucgcgcuggccgcugccgcuaucgccuggcugcucggcagcucuaccucccagaaagucauuuaucuggugaugauccuucugauugcgcccgccuacagcaucagauguauugggguuucuaaccgggacuuuguggagggaauguccggcgggacaugggucgauaucgugcucgaacauggaggcugcgugaccgucauggcucaggacaagccuacgguugauauugagcuggugacaaccacagugagcaauauggccgagguccgcucuuacuguuaugaggcuuccaucagcgacauggccuccgauucuagaugccccacccaaggggaagccuaccuugacaagcagagcgacacccaguauguguguaaacggacacugguugaucgcggauggggcaacggcugcggacucuucgggaagggcucccuggugacgugcgcuaaauuugcguguagcaagaaaaugaccgggaagucuauccagccugaaaaucuggaguacagaauuaugcucuccguccacggaagccaacacucuggcaugaucgugaacgacacagggcaugaaaccgaugagaaucgggccaagguugagauuacaccgaacagccccagagcugaagccacccugggaggcuucggcucccuugggcuggacugcgagccucgcacgggacucgauuuuucugaccuguauuaccuuacaaugaauaacaaacacuggcuggugcauaaggaaugguuccacgauaucccccucccuuggcacgccggcgcugacaccgggacaccccauuggaauaacaaagaggcccuggucgaauuuaaggaugcgcacgcuaaacggcagaccguggucgugcugggaagccaggagggcgccguucauaccgcccucgcuggggcccuggaggcugaaauggacggcgccaagggaagacuuuccagcggccaccugaaaugucgccucaagauggauaagcugcggcuuaaaggggugucuuauucccugugcacagcggccuucacguuuaccaagauuccggcugagacacuccauggaaccgucacaguggaaguucaguacgccggcaccgacgggccuuguaaagugcccgcucaaauggccgucgacaugcagacgcugaccccugugggaagacugaucacagcgaaccccgugaucaccgagagcacagaaaauucuaagaugaugcucgagcuggaucccccuuucggcgacuccuacauuguuaucggggucggcgagaaaaagauuacccaccacuggcaucgcagcggauccacgcuuggcaaggccuuuucuacaacccugaaaggggcucagcggcucgccgcucugggagauacagccugggacuucggcagcaucgggggaguguucaacuccauuggcagagccgugcaccaagucuuugggggcgcuuuccgcacccuguuuggaggcaugucuuggaucacccaggggcuuaugggagcgcuccugcuguggaugggcgugaaugcccgggauagaagcaucgcucucgccuuccuggccacagggggaguucuuguguuucuggcuacgaacguccaugcc

SEQ ID NO: 11125 - RNA, 2073 nt, Artificial Sequence
  ZIKV (isolate Z1106033) prME-short variant CDS opt
augaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacacacgugcgaugccacaauguccuacgaguguccuaugcucgacgaaggcguggagccggaugacguggauugcugguguaauaccacaucuaccugggucguguaugggacaugccaucacaaaaagggagaagcuagacggagccgcagagccguuacccugcccucccauucuacgcggaaacuucaaacccgcagccagacauggcuggaguccagagaguacaccaagcaccucauucggguggaaaacuggaucuuucgcaauccuggcuucgcgcuggccgcugccgcuaucgccuggcugcucggcagcucuacaucccagaaagucauuuaucuggugaugauccuucugauugcgcccgccuacagcaucagauguauugggguuucuaaccgggacuuuguggagggaauguccggcgggaccugggucgauguggugcucgaacauggaggcugcgucacgguuauggcucaggacaagccuacaguggauaucgagcuggugaccacaaccgucagcaauauggccgaggugcgcucuuacuguuaugaggcuuccauuagcgacauggccuccgauucuagaugccccacccaaggggaagccuaccuugacaagcagagcgacacacaguauguuuguaaacggacgcugguggaucgcggauggggcaacggcugcggacucuucgggaagggcucccuggugaccugcgcuaaauuugcguguagcaagaaaaugacagggaagucuauccagccugaaaaucuggaguacagaaucaugcucuccguccacggaagccaacacucuggcaugauuguuaacgacaccgggcaugaaacagaugagaaucgggccaagguggagaucaccccgaacagccccagagcugaagccacgcugggaggcuucggcucccuugggcuggacugcgagccucgcacaggacucgauuuuucugaccuguauuaccuuaccaugaauaacaaacacuggcugguccauaaggaaugguuccacgauauuccccucccuuggcacgccggcgcugacaccgggacaccccauuggaauaacaaagaggcccugguggaauuuaaggaugcgcacgcuaaacggcagaccgucgugguucugggaagccaggagggcgccgugcauacagcccucgcuggggcccuggaggcugaaauggacggcgccaagggaagacuuuccagcggccaccugaaaugucgccucaagauggauaagcugcggcuuaaaggggucucuuauucccugugcacggcggccuucaccuuuacaaagaucccggcugagacccuccauggaacagugaccguugaagugcaguacgccggcacggacgggccuuguaaaguccccgcucaaauggccguggacaugcagacccugacaccugugggaagacugauuaccgcgaaccccguuaucacagagagcaccgaaaauucuaagaugaugcucgagcuggaucccccuuucggcgacuccuacaucgucauuggggugggcgagaaaaagaucacgcaccacuggcaucgcagcggauccacacuuggcaaggccuuuucuaccacacugaaaggggcucagcggcucgccgcucugggagauaccgccugggacuucggcagcauugggggaguguucaacuccaucggcagagccguccaccaaguguuugggggcgcuuuccgcacccuguuuggaggcaugucuuggauuacacaggggcuuaugggagcgcuccugcuguggaugggcguuaaugcccgggauagaagcaucgcucucgccuuccuggccaccgggggagugcuugucuuucuggcuaccaacgugcaugcc

SEQ ID NO: 11126 - RNA, 2061 nt, Artificial Sequence
  ZIKV (strain MR 766) prME-short variant CDS opt
augaacgagggcagcaucauguggcuggccucccucgcuguggucauugccugcgcgggggcuaucaccagacggggaucugccuacuauauguaccuggaccgcagcgaugccggcaaggcuauuuccuucgccacaacgcuugggguuaauaaaugucacgugcagaucauggaccugggacauaugugcgaugcuaccaugucuuaugaaugucccaugcucgacgagggcguggaacccgaugacgucgauugcugguguaacacaaccagcacaugggugguuuacgggaccugccaccauaagaaaggagaggccagacggucccgcagagcggugacacugccgucucacagcacccggaaacuucaaacgcgcucccagaccuggcuggaaagcagagaguauacaaagcaucucauuaaggucgagaauuggaucuuucggaaccccggcuucgcccugguggcuguugccaucgcuuggcugcucgggucuuccaccagccagaaggugauuuaccuggucaugauccuucugauugccccugcguauucuauccgcuguauugggguguccaauagagacuuuguggaaggaaugagcggcgggacaugggucgauguugugcucgagcacggaggcugcgugaccgucauggcccaggacaaacccacgguggauaucgaacugguuacaaccacagugucuaacauggcugagguccgguccuacuguuacgaggccagcauuuccgacauggcuucugauagccgcugcccuacccaaggggaagccuaucuugacaagcaguccgacacccaguacguguguaaaagaacacugguugaucggggauggggcaauggcugcggccucuucggaaagggcagccuggugacgugcgccaaauuuaccuguucuaagaagaugacagggaaauccauccagcccgagaaccuggaauaucgcaucaugcucagcguccacggaucucaacauagcggcaugauuggguacgagaccgacgaagauagagcuaagguggaggucacaccuaauuccccgcgggcggaggccacccugggaggcuucggcucucuugggcuggacugcgaacccagaacgggacucgauuuuagcgaccuguauuaccuuacaaugaacaauaaacacuggcuggugcauaaggagugguuccacgauaucccucuccccuggcacgcuggcgccgacaccgggaccccucauuggaacaauaaagaagcccugguugaguuuaaggaugcucacgccaaacgccagacaguggucgugcugggaucccaggaaggcgcgguucauaccgcucucgccggggcccuggaggcugagauggacggcgccaagggacggcuuuucagcggccaccugaaguguagacucaaaauggauaagcugcgccuuaaaggggugucuuauucccugugcacagcugccuuuacguucaccaagguccccgcggaaacacuccauggaaccgugacaguggagguucaguacgccggcaccgacgggccguguaaaauuccuguccaaauggcuguggacaugcagacgcugacccccgugggacggcugaucacagccaacccugucauuaccgaaagcacagaaaauucuaagaugaugcucgagcuggauccucccuuuggcgacuccuacaucgugaucgggguuggcgauaagaaaauuacccaccacuggcauagaagcggauccacgcuuggcaaggcuuucucuacaacccugaaaggggcccagcgccucgcggcccugggagacacagcuugggauuucggcagcaucgggggaguguuuaacuccauuggccgggccguccaccaaguguucgggggcgcuuuuagaacccuguucggaggcaugucuuggaucacccaggggcuuaugggagcccuccugcuguggaugggcguuaacgcccgcgaccggagcauugcucucgcguuucuggccacagggggagugcuugucuuccuggcuacgaaugugcaugcc

SEQ ID NO: 11127 - RNA, 2073 nt, Artificial Sequence
  ZIKV (strain NatalRGN) prME-short variant CDS opt
augaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacacaugugcgaugccaccauguccuacgaguguccuaugcucgacgaaggcguggagccggaugacguggauugcugguguaauacaaccucuacaugggucguguaugggaccugccaucacaaaaagggagaagcuagacggagccgcagagccguuacacugcccucccauucuacccggaaacuucaaacgcgcagccagaccuggcuggaguccagagaguacacaaagcaccucauucggguggaaaacuggaucuuucgcaauccuggcuucgcgcuggccgcugccgcuaucgccuggcugcucggcagcucuaccucccagaaagucauuuaucuggugaugauccuucugauugcgcccgccuacagcaucagauguauugggguuucuaaccgggacuuuguggagggaauguccggcgggacaugggucgauguggugcucgaacauggaggcugcgucaccguuauggcucaggacaagccuacgguggauaucgagcuggugacaaccacagucagcaauauggccgaggugcgcucuuacuguuaugaggcuuccauuagcgacauggccuccgauucuagaugccccacccaaggggaagccuaccuugacaagcagagcgacacccaguauguuuguaaacggacacugguggaucgcggauggggcaacggcugcggacucuucgggaagggcucccuggucacgugcgcuaaauuugcguguagcaagaaaaugaccgggaagucuauccagccugaaaaucuggaguacagaaucaugcucuccgugcacggaagccaacacucuggcaugauuguuaacgacacagggcaugaaaccgaugagaaucgggccaagguggagaucacaccgaacagccccagagcugaagccacccugggaggcuucggcucccuugggcuggacugcgagccucgcacgggacucgauuuuucugaccuguauuaccuuacaaugaauaacaaacacuggcugguccauaaggaaugguuccacgauauuccccucccuuggcacgccggcgcugacaccgggacaccccauuggaauaacaaagaggcccugguggaauuuaaggaugcgcacgcuaaacggcagaccgucgugguucugggaagccaggagggcgccgugcauaccgcccucgcuggggcccuggaggcugaaauggacggcgccaagggaagacuuuccagcggccaccugaaaugucgccucaagauggauaagcugcggcuuaaaggggucucuuauucccugugcacagcggccuucacguuuaccaagaucccggcugagacacuccauggaaccgugacaguugaagugcaguacgccggcaccgacgggccuuguaaaguccccgcucaaauggccguggacaugcagacgcugaccccugugggaagacugauuacagcgaaccccguuaucaccgagagcacagaaaauucuaagaugaugcucgagcuggaucccccuuucggcgacuccuacaucgucauuggggugggcgagaaaaagaucacccaccacuggcaucgcagcggauccacgcuuggcaaggccuuuucuacaacccugaaaggggcucagcggcucgccgcucugggagauacagccugggacuucggcagcauugggggaguguucaacuccaucggcagagccguccaccaaguguuugggggcgcuuuccgcacccuguuuggaggcaugucuuggauuacccaggggcuuaugggagcgcuccugcuguggaugggcguuaaugcccgggauagaagcaucgcucucgccuuccuggccacagggggagugcuugucuuucuggcuacgaacgugcaugcc

SEQ ID NO: 11128 - RNA, 2100 nt, Artificial Sequence; identical to SEQ ID NO: 11112
  ZIKV (strain ZikaSPH2015) ME variant CDS opt

SEQ ID NO: 11129 - RNA, 2100 nt, Artificial Sequence; identical to SEQ ID NO: 11113
  ZIKV (isolate Z1106033) ME variant CDS opt

SEQ ID NO: 11130 - RNA, 2088 nt, Artificial Sequence; identical to SEQ ID NO: 11114
  ZIKV (strain MR 766) ME variant CDS opt

SEQ ID NO: 11131 - RNA, 2100 nt, Artificial Sequence; identical to SEQ ID NO: 11115
  ZIKV (strain NatalRGN) ME variant CDS opt

SEQ ID NO: 11132 - RNA, 2073 nt, Artificial Sequence; identical to SEQ ID NO: 11116
  ZIKV (strain ZikaSPH2015) ME variant CDS opt

SEQ ID NO: 11133 - RNA, 2073 nt, Artificial Sequence; identical to SEQ ID NO: 11117
  ZIKV (isolate Z1106033) ME variant CDS opt

SEQ ID NO: 11134 - RNA, 2061 nt, Artificial Sequence; identical to SEQ ID NO: 11118
  ZIKV (strain MR 766) ME variant CDS opt

SEQ ID NO: 11135 - RNA, 2073 nt, Artificial Sequence; identical to SEQ ID NO: 11119
  ZIKV (strain NatalRGN) ME variant CDS opt

SEQ ID NO: 11136 - RNA, 2100 nt, Artificial Sequence
  ZIKV (strain ZikaSPH2015) prME-short variant CDS opt
augggaagaaaacaaaacaaaagaggcggcaaugaaggaagcauuaugugguuagcaucacuagcaguaguaauagcaugugcgggcgcaguuacacgcagagguagugcauacuacauguaucuagauagaaaugaugcaggagaagcaauaucauuucccaccacauuaggaaugaauaaauguuauauucaaauaauggaucuaggacauaugugcgaugcaaccaugucauacgaaugccccaugcuagaugaaggaguagaacccgacgacguagauugcuggugcaauacgacuucaacauggguaguauacgggacaugccaucauaagaaaggggaagcccgaagaaguaggagagcaguaacacuaccuucucauucaacuagaaaauuacaaacuagaagucaaacuuggcuugaaucaagagaauauacaaaacaucuaauuagaguugaaaacuggauauucagaaacccagguuucgcauuagcugcugccgcgauagcaugguuauuaggcucaaguacuucacaaaaaguaauuuauuugguuaugauauuauuaauugcuccagcuuacucuauaagauguauaggugucagcaaucgagauuucguugaaggaaugucuggggguacaugggucgacauaguccuagaacaugggggauguguaacagugauggcacaagauaaaccuacaguugacauagaauuagugacaacaacugucucaaauauggcggagguaagauccuacuguuaugaagcaucaaucucagauauggcaagugacagcagaugcccaacccaaggugaagcauaccuugacaaacaaagcgacacccaauauguauguaaacguacauuaguagauagaggguggggaaacggguguggauuauuuggaaagggaagucuaguaacaugugcaaaauucgcauguuccaagaaaaugacaggaaaaucaauacaaccagaaaauuuggaauauagaauaauguuaucaguucacggaucacaacacucgggaaugauuguaaacgauacuggacaugaaacagacgaaaauagagcaaaaguagaaauaacuccaaacucaccgagagcagaagcaacacucggugguuucggaucauuaggauuggauugugaaccaaggaccggacuggacuucucagauuuauacuacuuaacaaugaauaauaaacauuggcugguacauaaagaaugguuccacgacauaccauuaccauggcaugcaggagcagauacaggaacaccacacuggaauaauaaagaagcucuaguugaguuuaaagaugcucaugcaaaaagacaaacagucguuguauuagggagucaagaaggagcgguucauacagcauuagcaggagcauuggaagccgaaauggacggagcaaaaggaagauuaaguucaggccacuuaaaauguagauugaaaauggacaaauuaagacuaaaaggaguaucguauagccuaugcacagcagcauuuacauuuacaaaaauaccagcagaaacccuacaugguacaguaacaguagaaguucaauacgcaggaacagaugguccuuguaaaguuccagcccagauggcaguagauaugcagacauuaacaccagucggcagauuaauaacagccaauccgguaauaacagaaucaacagaaaauagcaaaaugauguuagaacuagacccacccuuuggcgauucauauauaguaauagguguaggagaaaagaaaauaacucaucacuggcaucgaaguggaucaacuauagguaaagcauuugaagcaacaguacgcggagcaaaaagaauggcuguauuaggagauacggccugggacuuugguucaguugguggagcacuaaacucacuaggcaaaggaauacaucaaauuuuuggcgcagcuuucaaaucauuauuuggaggaaugucuugguucucacaaauauuaauaggaacauuauuaaugugguuaggauuaaacacuaaaaauggaucaauaaguuugaugugccuagcuuuaggugguguacuaauauuucuaucaacagcaguuucagca

SEQ ID NO: 11137 - RNA, 2100 nt, Artificial Sequence
  ZIKV (isolate Z1106033) prME-short variant CDS opt
augggacguaaacaaaauaaaagagguggaaaugaaggaaguauuaugugguuggcaagcuuagcaguaguaauagcaugcgcgggggcuguaacuaggaggggaagugcauacuacauguaucuagacagaaacgaugcaggugaagcaauuaguuuuccuacuacauuaggcaugaauaaauguuacauacaaaucauggauuuaggacauacaugugaugcaacuaugaguuaugaauguccuauguuagaugaaggcguugaaccagaugacguagacuguugguguaauacaacaaguacuuggguaguauaugggacgugucaucacaaaaaaggagaagcaagaagaucaagaagagcuguuacacuuccaagucauucgacaagaaaacuacagacaagaucucagacuuggcuagaaagcagagaauauaccaaacauuuaauuagaguagagaauuggauauuuagaaauccaggauucgcauuagcagcagcugcaauagcaugguuauuaggaagcaguacgucacaaaagguaauauaccuaguaaugauauuauuaauagcaccugcauacaguauaagaugcauaggaguaaguaacagagauuuuguagaaggcaugagugguggaacauggguagaugucguacuugagcaugguggguguguaacuguaauggcacaagauaaaccaacaguagacaucgaauuagugacaacaacaguaagcaauauggcagaaguacggucauauuguuacgaagcgaguaucucugacauggcaucagauaguagaugucccacacaaggggaagcuuauuuagauaaacaaucagauacacaauacguauguaaaagaacguuaguggaucgcggauggggaaauggauguggacuauucggcaaaggauccuuaguaacaugugcgaaauucgcaugcucaaaaaaaaugacaggaaaaucaauacaaccagaaaauuuagaauaucguauuaugcuaaguguacauggaucucaacacagcggaaugauaguaaacgauacuggacacgaaacagacgaaaauagggcaaaaguggaaauuacacccaauucaccaagagcagaagcuacuuuaggagguuuuggaaguuuagguuuagacugcgaaccgcguacaggauuagauuuuagugacuuauauuaucugacuaugaauaauaaacauugguuaguucauaaagaaugguuucaugauauaccacuuccuuggcaugcgggagcagacacaggaacaccacacuggaauaauaaagaagcauuagucgaauuuaaagaugcacaugcaaaaaggcaaacaguaguaguacuaggaucacaagaaggagcuguacauacagcacuagcaggagcauuagaagcagaaauggauggugcaaaaggaagacuuagcucuggacauuuaaaaugcaggcuaaaaauggacaaauugagauuaaaaggcguaucauauucguuauguacagccgcguuuaccuuuacaaaaauaccagcagaaacacuacacgguacaguuacaguagaaguacaauacgcaggaacagacggaccuuguaaaguaccagcacaaauggcagucgacaugcagacauuaacaccaguagguagacuaauuacagcaaauccaguaauaacagaaucuacagaaaacucaaaaaugauguuagaauuagaucccccauuuggagauaguuauauuguuauaggaguaggggaaaaaaaaauaacacaucauuggcacaggucagggaguacaauaggaaaagccuuugaggcaaccguaagaggagcaaaaagaauggcaguauuaggagauacagcaugggauuuuggaaguguaggaggagcgcuaaauagucuaggcaaaggaauucaucaaauuuucggagccgcauucaaaucauuauuuggaggaaugagcugguuuucucaaauacuaauugguacuuuauuaaugugguuaggauuaaacgcaaaaaauggaagcauaaguuugaugugcuuagcacuagguggaguauuaauauuucugagcacagcaguaagugcu

SEQ ID NO: 11138 - RNA, 2088 nt, Artificial Sequence
  ZIKV (strain MR 766) prME-short variant CDS opt
augggaagaaaacaaaauaaaaggggugguaaugaagguucuaucaugugguuagcaucguuagcaguagugauagcuugugcaggagcuauaacaagacgaggaucagcauacuauauguacuuagacagaagugacgcaggaaaagcaauuucauuugcuaccacauuaggaguaaauaaaugccauguacaaauaauggauuuaggacacaugugugacgcaacaauguccuaugaaugcccuauguuggaugaagguguugaaccagaugauguugauugcugguguaauacgacaaguacuuggguuguuuauggaacaugccaucauaagaaaggagaagcaaggagaucaagacgagcagucacacuaccaucacacucaacaagaaaacuacaaacacgcucacaaacauggcuagaaagcagagaauauacaaaacauuuaauaaaaguggagaauuggaucuuuagaaauccaggguuugcgcuuguagcuguagcaauagcaugguugcuuggaaguucuacaagccaaaaaguuauauaucuaguaaugauauuauugauagcaccagcguauucaauaagauguauuggaguaagcaauagagauuuuguagaaggcaugucaggaggaacauggguagacguaguucucgaacauggaggcuguguaacaguaauggcacaagauaaaccuacgguggacauagaguuaguaacaacaacaguauccaauauggcugagguucgaucauauugcuacgaagcaagcauaucagacauggccagcgauucaagauguccaacucaaggggaagcauaucuugauaaacaaagcgacacgcaauacguauguaaaagaacucuaguagauaggggauggggaaaugguuguggauuauuuggaaaaggaucauuaguaacaugugcuaaauuuacauguucaaagaaaaugacaggaaaaaguauacaaccugaaaauuuggaauacagaauaauguuaagcguacauggaagccaacauucaggaaugaucggauaugaaacagaugaagauagagccaaaguagaagugacaccaaauucaccuagagccgaagcgacacuugggggauucggaagucuaggauuagacugugaaccuagaacaggacuagauuuuagcgaccuauauuauuuaacaaugaacaacaaacauuggcuaguacauaaagaaugguuccaugauauaccauuaccauggcacgcaggagcagauacuggaaccccacacuggaauaauaaagaggcccugguagaguucaaagacgcucaugcaaaaagacaaacaguggucguuuuaggaucacaagaaggagcgguacauacugcccuagcuggagcucuagaagcagaaauggauggagcuaaaggaagguuauuuucgggacauuuaaaauguagacuaaaaauggauaaauuacgacuaaaggguguauccuauaguuuauguacagccgcuuuuacauuuacuaagguuccggcagaaacauuacacgggacuguaacaguagaaguacaauaugcgggaacagauggaccguguaaaaucccgguucaaauggcaguagauaugcaaacauuaacaccaguuggaagauuaauaacagcuaacccagugauaacagaaaguacagaaaacagcaaaaugauguuagaauuagauccaccauuuggagauaguuauauaguuauaggaguaggagauaagaaaauaacacaccauuggcauagaucugguagcacaauaggaaaagcauuugaagcaaccguucgaggagcaaaaagaauggcaguauuaggagauacugcaugggauuuugggagcguaggaggaguauuuaacucauuaggaaaaggaauacaucaaauauuuggagcagcauucaaaucgcuauuuggaggaaugaguugguuuagccaaauacuaauugggacucuauuaguaugguuaggacuaaauaccaaaaauggaagcauaaguuuaacaugccuagcauugggaggaguaaugauauuuuuaagcacagccguuucagcc

SEQ ID NO: 11139 - RNA, 2100 nt, Artificial Sequence
  ZIKV (strain NatalRGN) prME-short variant CDS opt
auggguagaaaacaaaacaaaagagguggaaaugaaggaucaauaaugugguuagcuucacuagcagucguaaucgcuugugcaggagcuguaacuagaagaggaagugcauauuauauguaccuagauagaaaugaugcaggagaagcuauuaguuuuccaacaacacuagguaugaauaaaugcuauauacaaaucauggaucuaggacauaugugugaugcaaccaugucauaugaauguccuaugcuugaugaagguguugagccggaugacguggauuguugguguaauacuacgaguacauggguaguguauggaacaugucaucauaaaaaaggagaagcccgccgaaguagaagggcaguaacgcuaccaagucauucuacaaggaaacuacaaacaagaucacaaacaugguuggaaucacgagaauauacgaagcaucuuauuagaguugaaaauuggauuuucaggaauccaggauucgcuuuagcggcggcagcaauagcuuggcuacuaggaaguaguacuucacaaaaaguaauauauuuaguaaugauacuauugaucgcaccggcauacucaauaagauguauaggaguuucaaauagagacuuuguagaaggaaugagcgguggcaccuggguugauguuguauuggaacacggaggaugcguaacagucauggcacaagauaaaccaacaguagauauagaauuaguaacaacaaccguaaguaauauggcagaaguacgaucauauuguuaugaggcaaguauaucugauauggcuucagacucacguuguccaacucaaggcgaagcauaccuagauaaacaaucagauacucaauacguaugcaaaagaacauuaguagauagaggguggggaaaugguuguggauuauucggaaaaggaucauuaguaacuugugcaaaauucgcaugcaguaaaaaaaugacaggaaaaaguauacaaccagaaaauuuagaauacagaauaauguuaaguguacacggaagccaacauaguggaaugauuguaaaugauacuggacaugaaacggacgaaaaccgugcuaaaguagagauaacaccaaauagcccgagagcagaggcaacauuagguggauuugguaguuuagguuuagacugcgaaccucguaccggguuagacuuuagugacuuauauuauuuaacaaugaauaacaaacauugguuagugcauaaagagugguuccacgauauaccucucccuuggcaugccggagcugacaccggaacaccacauuggaacaauaaagaagcauuaguagaauuuaaagacgcacacgcaaaaagacaaacaguaguuguauuaggaucacaagagggugccguacauacagcacuugccggagcauuagaagcugaaauggauggagcuaaagguagacuuucaucaggacauuuaaaauguagauuaaaaauggauaaauuaagacucaaaggagucucauacagucuuuguacagcugcauuuaccuuuaccaaaauuccagcagagacacuacauggaacaguaacuguagagguacaauaugcaggaacagauggaccauguaaaguaccugcacaaauggcaguagauaugcaaaccuuaacaccaguaggaagauuaauuacagcuaaucccguaauaacugaaaguacagaaaacaguaaaaugauguuagaauuagauccaccauuuggugauagcuauauaguuauaggaguaggcgaaaaaaaaauaacucaucauuggcauagaagcgguagcacaauuggaaaagcauuugaagcaacuguaagaggagcaaaaagaauggcuguacuaggagauacagcaugggauuuuggaagcguuggaggagcacuaaauucauuaggcaaaggaauacaucaaauauuuggagcagcauucaaaagcuuauucggaggaaugucaugguuuucgcaaaucuuaauaggaacuuuacuaaugugguuaggacuaaauacuaaaaacggaucuauuagcuuaaugugcuuagcacuaggaggaguguuaauuuucuugucaacagcuguaagugcu

SEQ ID NO: 11140 - RNA, 2073 nt, Artificial Sequence
  ZIKV (strain ZikaSPH2015) prME-short variant CDS opt
augaaugaaggaucuauaauguggcuagcuagucuugcugucguuauugcaugugcaggagcaguaacgcgaagagguucagcauauuacauguauuuagauagaaaugaugcgggagaagcaauaucauuuccaacuacauuaggaaugaacaaauguuauauccaaaucauggauuuaggccauaugugugaugcuacaaugucauaugaaugcccuaugcucgaugaaggaguagaaccagaugauguagauuguugguguaauacaacaagcacauggguuguauauggaacaugucaucacaaaaaaggagaagcgcgaagaucacgaagggcuguaacauuaccgucacauucaacacgaaaauugcaaacaagaagucaaacauggcuagaaucccgugaauauacaaaacauuuaauaagaguagaaaauuggauauucagaaauccagguuucgcauuagcagcggcugcaauagcaugguuauuagguaguagcacaagucaaaaaguaaucuaucuaguaaugauacuucuaauagcaccugcauauucaauaagaugcauaggcguuagcaauagagacuucguagaagggaugucagguggcacguggguagacauagugcuagaacauggaggauguguaacagucauggcccaagauaaaccuacaguagauauugaacuaguuacaacuacaguuucaaauauggcugaaguaagaucauauuguuacgaagcaaguauuucagauauggcaucagauaguagaugcccaacacaaggugaagcauaccucgauaaacaaagcgacacgcaauauguauguaaaagaacccuaguugacagagguuggggaaacggaugcggauuauuugggaaagguucacuaguaacaugcgcaaaauuugcaugcucaaaaaaaaugacaggcaaaucaauacaacccgaaaaucuagaauacagaauuauguuaucaguccauggaagucaacauucaggaaugauagucaaugauacaggacaugaaacagaugaaaacagggcaaaaguagagauaacuccaaacucaccuagggcagaagcaacuuugggagguuucggaagcuuaggauuagacugcgaaccuagaacagguuuagauuuuagcgacuuauacuaucuuacaaugaacaauaagcacugguugguacauaaagagugguuucacgacauaccuuuaccauggcacgcaggugcagacacaggaacaccucauuggaauaauaaagaagcauuaguagaauuuaaagaugcacaugcaaaacgucaaacgguagucguacuaggcucccaagaaggagcgguacauaccgcacuugcaggcgcauuagaagcagaaauggauggagcaaaaggaagacuaagcucaggucaucuaaaauguagauugaagauggauaaauuaagauuaaaagggguuaguuacucguuauguacagcagcauuuacauucacaaaaauaccagcggaaaccuuacacggcacuguaacggucgaaguucaguaugcaggaacugaugguccauguaaaguaccagcacaaauggcaguagauaugcaaacauuaacaccuguaggaagguuaauuacugccaacccaguaauaacagaaaguacagagaauucaaaaaugaugcuagaacuagauccuccguucggagacaguuauauaguaauaggaguaggagaaaaaaaaauuacacaucauuggcauagaaguggaucaacaauaggcaaagcauucgaagcuacaguuagaggugcaaaaagaauggcaguacuaggcgacacagcaugggacuuuggaucaguugggggagcucuaaacagcuuaggaaaaggcauacaccaaauauucggagccgcuuuuaaaagucuguuuggaggcaugagcugguuuucacaaauucuuauaggaacauuguuaaugugguuaggauuaaauacgaaaaauggaucaauaucauuaaugugcuuagcacucggaggcguauuaauuuuuuuaucgacagccguaucagca

SEQ ID NO: 11141 - RNA, 2073 nt, Artificial Sequence
  ZIKV (isolate Z1106033) prME-short variant CDS opt
augaaugaaggaaguauaaugugguuagcuagucuugcaguaguaauagcuugcgcaggagccguaacaagaaggggaagugcauauuauauguacuuagauagaaacgaugcuggagaagcaauaaguuuuccaacaacauuaggaaugaacaaauguuauauacaaauaauggacuuaggucauacaugugaugcaacaauguccuaugaauguccuaugcuugacgaaggaguagaaccagaugauguagacuguugguguaacacaaccucuacauggguaguuuacgguaccugucaucauaaaaaaggggaagcaagaagaagccgucgugcaguuacacucccaagccacagcacuagaaaauuacaaacaagaagucaaacuugguuagaaucaagggaauacacaaaacacuuaauuagaguggaaaauuggauauucagaaauccuggauuugcucuggccgcugcagcaauagcuuggcuauuaggaucaagcacuagucaaaaaguuauauaucuaguaaugauauuacucauagcaccagcauauucaauaagauguauagguguaucaaacagggacuucguagaaggaaugagugguggaacauggguagauguaguacuagaacacggaggcugcgucacaguaauggcucaagauaaaccaacaguagauauagaacucguuacgacaacaguaaguaauauggcagaaguuagaaguuauuguuaugaagcaucaauaagugauauggcaagugacagcagaugcccaacacagggugaagcauaucuagacaaacaaucugauacacaauauguuugcaaaaggacauuaguugauagaggaugggguaauggauguggauuauuugguaaaggaaguuugguaaccugcgcaaaauucgcuuguucgaaaaaaaugaccggaaagucaauacagcccgaaaaccuagaauauagaauaaugcuuucaguacacggaucacagcauaguggcaugauagugaaugacacaggucaugaaacagacgaaaauagagcaaaaguagaaaucacaccaaauucaccacgagcugaagcaaccuugggaggauuuggcagcuuaggacuagauugugaaccaagaacuggauuagauuuuucagaucuauauuacuuaacaaugaacaacaaacauugguuagugcacaaagaaugguuucacgacaucccacuacccuggcacgcuggugcagacacagggacuccucauuggaacaacaaagaagcauuaguagaauuuaaagaugcucaugcaaaaagacaaaccguuguaguccuuggaagucaagaaggcgccguacacacagcauuagcuggagcacuagaagcggaaauggauggagcaaaaggaagacuaucaucaggacaucuaaaauguagauuaaaaauggauaaauuaagacuaaaagguguaaguuacaguuuauguacagcugcauuuaccuucacuaaaauucccgcagaaacacuccacggaacaguaacaguagaagugcaauacgcuggaacagauggaccauguaaaguaccugcacaaauggccguagacaugcaaacauuaaccccaguaggcagauugaucacagcuaacccaguaauaacugaaagcacagaaaauagcaaaaugauguuagaacuugauccuccguuuggcgauaguuauaucguaauagggguaggagaaaaaaaaauuacacaucauuggcauagaaguggaaguacaauaggaaaagcauuugaagcaacuguaagaggugcaaaaagaauggcaguauuaggugauacagcgugggauuuuggaucaguuggaggagcauuaaauaguuuaggaaaagguauacaucaaauauuuggagcugcguucaagucacuauuuggaggaaugaguugguuuagccaaauacuaauagguacgcuacuaaugugguugggcuuaaacgcaaaaaacggaaguauuucacuaauguguuuagcacuaggaggagugcuuauauuucuuaguacagcaguaagcgca

SEQ ID NO: 11142 - RNA, 2061 nt, Artificial Sequence
  ZIKV (strain MR 766) prME-short variant CDS opt
augaaugaaggaucuauuaugugguuagcaucacuagcggugguaaucgcaugcgccggcgcaaucacaagaagaggaucagcauauuauauguaccucgaucgaucagaugcuggaaaagcaauaucauucgcaacaacauuaggaguuaauaaaugccauguacaaauuauggacuuaggacauaugugcgaugcaacuaugucauaugaauguccaaugcuagaugaaggaguggaaccagaugauguagauuguugguguaacacaacaagcacauggguaguuuacggaacuugucaucauaagaaaggagaagcgcgacgaucaaggagagcaguuacacuaccaagucacaguaccagaaaacuacagacaagaucacaaacaugguuagagaguagagaauauacgaaacaccucauaaaaguagaaaauuggauauucagaaauccaggauuugcucuaguugcagucgcaauagcaugguuauuaggaucaaguacgagucaaaaaguaauauacuuaguaaugauauuacuaauagcaccagcauauucuauuagaugcaucggaguuucaaauagagauuucgucgagggaaugucaggaggaacuuggguagaugugguauuagaacacggaggaugcguaacaguaauggcacaagacaaaccaacagucgauauagaauuagugacaacaacaguaagcaauauggcagaaguaagaucauauuguuaugaagccucaauaagcgauauggcgucagauucaagaugcccaacacaaggagaagcauacuuagacaaacaaucugacacacaauaugucugcaaaagaacucuagucgacaggggcugggguaacggaugcggauuauucgguaaaggaucauuaguaacaugugcaaaauucacauguaguaagaaaaugacuggcaaaagcauucaaccagaaaaucuagaauacaggauaaugcuaucaguacacggaagccaacacagcggaaugauaggauacgaaacagaugaagauagagcaaaaguagaaguaacaccgaacaguccacgagcugaagcgacauugggcggguucggaucauuaggauuagauugugaaccgagaacagguuuagauuuuagcgaccuguauuacuuaacaaugaauaauaaacauuggcuaguacauaaagaaugguuccaugauauaccacugccauggcaugcaggggcagauacagguacaccacacuggaauaacaaagaagcauugguagaauuuaaagaugcacaugccaaacgacaaacgguagugguauuagggucacaagagggagcuguacauacagcauuagcaggagcacuggaagccgaaauggauggugcaaaaggaagauuguucaguggacaucuaaaaugcagauugaaaauggauaaacuacgauuaaaagggguaucauauucacuauguacagcagcauuuacauuuacaaaagugccagccgaaacuuugcaugguacaguaacaguagaaguacaauaugcagguacagauggaccauguaaaauaccuguucagauggcagucgacaugcaaacacuuacaccuguuggaaggcuuauaacagcaaauccagugauaacagaaucaacagaaaauagcaaaaugaugcuagaacuagauccacccuuuggagauucauacauaguaauuggggucggagauaagaaaauaacucaucauuggcauagaucuggaagcacuauaggaaaggcuuucgaagcaacaguaagaggagcaaaaagaauggcaguauuaggagauacagcaugggauuuuggaagcguagguggaguauuuaauucguuaggaaaaggaauccaucaaauuuuuggagcagcauucaaaagucuauuuggagguaugucuugguuuagccaaauauuaauagguacauuacuuguauggcuaggacuaaauacuaaaaacgggucuauaaguuuaacaugcuuagcacuaggagggguaaugauauuuuuaagcacagcaguaagugca

SEQ ID NO: 11143 - RNA, 2073 nt, Artificial Sequence
  ZIKV (strain NatalRGN) prME-short variant CDS opt
augaaugaaggaucaauaauguggcuagccaguuuagcgguaguaaucgcaugugcuggagcaguaacaagaagaggaagcgcuuacuauauguauuuagacaggaacgaugcaggugaagccauaaguuuucccacaacacuaggaaugaacaaauguuauauucaaauaauggaucuaggacauaugugugaugcuacuaugaguuaugagugcccaaugcuagacgagggaguggaaccugaugacguagacugcuggugcaauacaacaagcacauggguaguuuauggaacaugucaccauaaaaaaggagaagcucggcgaucaagaagagcaguaacauuaccuagucauaguacgagaaaacuacaaacaaggagccaaacaugguuagaaucacgugaauacacaaaacauuuaauaagaguagagaacuggauauuuagaaacccaggcuuugcacuagcagcagcagcaauagcaugguuauuaggaucaucgacaagccaaaaaguaauauaucuagugaugauauuacuaaucgcaccagcauauagcauaagauguauaggaguuagcaauagagacuucguagaaggaaugucaggcggaacauggguagauguaguuuuagaacauggaggauguguaacaguaauggcucaagacaaaccaacagucgauauugaacuaguaaccacgacaguaagcaacauggcugaaguacgaucauauuguuaugaggcaagcauauccgacauggcaucggacucaagauguccaacacaaggugaagcauauuuggauaaacaaucagauacacaauauguguguaaaagaacuuuaguugaucgcggaugggguaacggaugugguuuauuuggaaaaggaucacuaguuacaugugcaaaauucgcaugcaguaaaaaaaugacgggaaaaagcauacaaccggaaaaucuagaauauagaauaauguugaguguacauggaucacaacauaguggaaugauaguaaaugauacaggccacgaaacagaugaaaauagagcaaaaguugaaauuacaccaaauagcccacgagcagaagcaacacuagggggauucggaagucuaggguuagacugcgaaccaagaacggguuuggauuuuagugaucuauauuaucuuaccaugaauaacaaacauuggcucguacauaaagaaugguuucaugauauaccauuacccuggcaugcaggagcagauaccgguacgccucauuggaauaauaaagaagcauugguagaauucaaggaugcacacgcgaaaaggcaaacuguaguaguauuaggaagccaagaaggagcaguacacacagcauuagcuggugcacuagaagcugaaauggauggagcaaaaggaagauuaaguucaggucauuuaaaauguagauuaaagauggauaaauuaagauuaaaagggguaaguuacucauuauguacugcggcauuuacauuuacaaaaauaccagcagagacucuacaugguacaguaacaguugaagugcaauaugcagguaccgauggaccauguaaaguaccagcacaaauggcaguugauaugcaaacacuuacaccagucgggagacuaauaacugcaaacccaguaauaacagaaucaacagaaaacaguaaaaugaugcuagaauuagauccaccauuuggagacaguuauauaguaauaggaguaggugaaaaaaaaauuacacaccacuggcacagaucaggaaguacgauaggaaaagccuuugaagcgacagugagaggagcaaaaagaauggcaguauuaggagacacagcaugggauuuugguaguguuggaggcgcucuaaauucacuagguaaaggaauacaucaaauauuuggagcagcauuuaaaagccuauuuggagggaugucaugguucagucaaauucuaauaggaacacuauuaaugugguuaggacuaaauacaaaaaacggaucaauaucuuuaaugugucuagcauuaggaggcguauuaauauuucuuagcacagcgguaucagca

SEQ ID NO: 11144 - RNA, 2100 nt, Artificial Sequence
  ZIKV (strain ZikaSPH2015) prME-short variant CDS opt
augggaaggaaacaaaauaaaagaggugguaaugaaggaucaauaaugugguuagcaucacuagcagucgucauagcuugcgcgggagcaguaacuagaagaggaucggcuuacuacauguauuuagauagaaaugaugcaggagaagcuauaucuuucccgacaacacucggaaugaauaaauguuauauccaaauuauggaucuuggacauaugugcgaugcaacaaugagcuaugaauguccaauguuagaugaggguguugaaccggaugauguagauuguuggugcaauacaacaucaacauggguaguauacggaacaugucaccauaagaaaggagaagcuagaagaagcagacgagcaguaacacuaccaagucacucaacaagaaaauuacaaaccagaagucaaacuugguuagaaagucgagaauauacaaaacaucuuauacggguagaaaauuggauauuuagaaauccuggauucgcacuugcagcggcagccauagccuggcuauugggcagcaguacaagccaaaaaguaauuuaucuuguaaugauauuauuaauagcuccagcauauagcauuagauguauaggaguaagcaacagagauuuuguagaaggaaugucaggaggaacauggguugauauaguauuagaacacggugguuguguaacaguaauggcacaagauaaaccuacaguagacauugaacuuguaaccacaacaguuaguaauauggcagaaguaagaucauacuguuaugaagcuaguauaucagauauggcaagugacucaagauguccaacacaaggagaagcauauuuagacaaacaaucagauacacaauacgugugcaaaagaacauugguagacagaggaugggggaauggauguggauuauucggaaaaggaucauuaguaaccugugcaaaauuugcauguaguaagaaaaugacagguaaaucaauacaaccugaaaaucuagaauauagaauaaugcuauccguacacggcagccaacacuccggaaugauaguaaaugacacuggacaugagacugaugaaaaucgagcaaaaguagaaauaacaccuaauagccccagagcagaagcaacauugggaggauuugguagcuuaggauuagacugcgaaccuagaacuggcuuagauuuuuccgacuuauauuauuuaacaaugaauaauaaacauugguuaguacauaaagagugguuucaugacauaccacuaccguggcacgcaggagcagauacaggaacuccacauuggaacaauaaagaagcccuaguagaauuuaaggacgcacaugcaaaaagacaaacaguaguaguuuuggggucacaagaaggagcaguacauacagcauuagcaggcgcacuagaagcugaaauggauggcgcaaaaggacgauugagcucaggucauuuaaaaugcagacuuaaaauggauaaauuaagacugaaaggggugucuuauucgcuauguacagcugcauuuacauucacaaaaauaccagccgaaacauuacacggaacagucacaguagaaguucaguaugcuggaacugacggcccauguaaaguuccagcacaaauggcaguagauaugcaaaccuuaacaccuguaggaagguuaauuacagcaaauccaguaauaacagaaucaacagaaaauaguaaaaugauguuagaauuagacccaccuuuuggagauaguuacauaguaauuggagucggagagaagaaaauuacacaucacuggcacagaagcggaagcacauuaggaaaagcauuuagcacaacguuaaaaggagcacaaagauuagcugcauuaggagauacagcaugggauuucggaucaaucggaggaguuuucaauaguauagggagagcaguacaccaaguauucggaggagcauucagaacacuauucggaggaaugaguuggauaacacaagguuuaaugggagcacuacuauuauggaugggcguaaacgcccgcgaccgaucuaucgcauuagcauucuuagcaaccggcggcguacuuguuuuccuagcaacaaacguacaugcc

SEQ ID NO: 11145 - RNA, 2100 nt, Artificial Sequence
  ZIKV (isolate Z1106033) prME-short variant CDS opt
augggaagaaaacaaaauaaaaggggagguaaugaaggaucaauaaugugguuagcaaguuuagcuguaguaauagcaugugcaggagcaguaacaagaagagguagcgcauacuacauguauuuagacagaaacgaugcaggagaagcaauuuccuuccccacaacuuuaggaaugaauaaauguuauauacaaauaauggauuuaggacacacaugugaugcuaccaugucauaugaaugucccaugcuagaugaaggaguagaaccagacgacguugauuguugguguaauacaacaaguacuuggguuguauaugggacaugucaucauaagaaaggcgaagcucgaaggucaagacgagccguaacauugccgagucauucaacaagaaaauuacaaacgagaucacaaacauggcucgaaucaagagaauacacaaaacacuuaauaagaguugagaacuggauauucagaaauccugguuuugcauuagcagcagcugccauagcauggcuauuaggaaguagcacaucucaaaaaguuauauacuugguaaugauucuauuaauagcuccagcauauucuauaagauguauaggaguuaguaaccgagacuuuguagaaggaaugagcggaggaacguggguagacguaguauuagaacauggaggaugcguaacaguaauggcacaagauaaaccaacagucgauauagaauuaguaacaacaacaguaucaaauauggcggaaguaaggaguuauuguuaugaagcaucaauaagugacauggcaagugauaguagaugucccacacaaggugaagcguauuuagauaaacaaagugauacacaauauguuugcaaaaggacauuaguagauaggggauggggaaacgguuguggauuauuugguaaaggaagucugguaacaugugcaaaauucgcuugcucaaagaaaaugacaggaaaaucuauacaaccagaaaauuuagaauacagaauaauguuaagcguacauggaagucaacacucaggaaugauagucaaugauacaggucaugaaacagaugaaaacagagcaaaaguagaaauuacaccaaauucaccgagagcagaagcgacauuagguggauucgggaguuuaggccuagacugugagccccgaacaggucuagauuuuucagauuuguauuaccuaaccaugaauaauaaacacuggcugguacauaaagaaugguuccacgauauaccacuuccauggcaugcaggagcagacacaggaacaccacauuggaauaacaaagaagcauuaguggaguucaaagacgcucaugcuaaaaggcaaacuguuguuguuuuaggaagucaagaaggagcuguacacacggcacuagcgggugcauuagaagcagaaauggauggagcaaaagguagacuaucaucaggacacuuaaaaugccgguuaaaaauggauaaacuaagauuaaaaggagucaguuauucauuaugcacugcagcuuuuacauucacuaaaauuccggcagaaacacuacauggaacagucaccguagaaguacaauaugccggaacagauggacccuguaagguuccggcacaaauggcaguagauaugcaaaccuugaccccaguaggaagauuaauaacagcaaacccaguaauaacggaaaguacagaaaauucaaagaugaugcucgaauuggauccaccauuuggagauucauauauaguuauuggaguuggagaaaagaaaauuacacaccauuggcauagaaguggaucaacauuaggaaaagcauuuucgacaacauuaaaaggagcacaaaggcuagcagcauuaggagauacagcaugggauuuuggcaguauugguggaguguuuaauucgauaggcagagcaguucaucaaguauuuggaggagcauucagaacauuguucggaggaaugaguuggaucacccaaggauuaaugggagcauuacuacuauggaugggagucaaugcaagagauagaagcauagcauuggcuuuucuggcuacaggaggaguucuaguauuuuuagcaacaaacguacaugca

SEQ ID NO: 11146 - RNA, 2088 nt, Artificial Sequence
  ZIKV (strain MR 766) prME-short variant CDS opt
augggacguaaacaaaauaaacgaggaggaaacgaagguucaauaauguggcucgcaagucuagcaguaguaauagcaugugcaggagcaauaacaagaaggggaucugcauacuacauguauuuagacagaucagacgcaggaaaagcaauaaguuuugcuacaacauuaggaguaaauaaaugucacguacaaauaauggaccuaggacacaugugugaugcuacaaugucauaugaauguccuaugcucgaugaaggaguagaaccugaugacguggauuguuggugcaacaccacaagcacauggguaguauacggaacaugucaucacaaaaaaggagaagccagaagaagcagaagggcaguuacauugccgagucauuccacaaggaaauuacaaacaagaucacagacuugguuagaaaguagagaauacacaaaacauuugauaaaagucgaaaauuggauuuuccgaaauccaggauuugcauuaguagcaguagcaauagcaugguuauugggaagcagcacaagucaaaaaguaauauaccuuguuaugauacuacuaauagcuccagcuuacucuauacgauguauugguguaagcaauagagauuuuguagaaggaaugucaggaggaacauggguagacgugguacuagaacauggaggcuguguaacgguaauggcacaagauaaaccgacaguagauauagaauuaguaacaacaacugugaguaauauggcagagguaagaaguuauugcuaugaagcaucuauaagcgacauggcaucagauucgagaugccccacacaaggagaagcuuauuuagacaaacaaucagacacacaauacgucuguaaacggacgcuagucgacagggguugggguaaugguugcggucuauuuggcaaaggaucauuaguaacaugugcuaaauuuacuuguucuaaaaaaaugacaggaaaauccauucaaccagaaaauuuagaauauagaauaaugcuaucaguacaugguagucaacauaguggaaugauaggauaugagacugaugaagauagagcuaaaguugaaguaacaccgaacaguccacgagcagaggcaacacuaggaggauuuggaucauuaggacucgauugugaaccaagaacaggauuagauuuuucagaucuauauuacuuaacaaugaauaauaaacauugguuaguacauaaagaaugguuucaugauauaccacuaccuuggcaugcgggagcagacacgggaacuccacacuggaauaacaaagaagcacuuguagaauucaaagacgcacaugcaaaacgacaaacagugguaguauuaggaucacaagagggugcaguacauacagcuuuagcaggagcacuagaagcagaaauggacggugcaaaagguagauuauucucuggucacuuaaaaugcagauuaaaaauggauaaauuaagauuaaaaggaguuaguuauucauuauguacagcggcauuuacauuuacuaaaguaccagcugaaacauuacacgguacagucacaguugaaguacaauaugcaggaacugauggcccuuguaaaauaccaguacagauggcaguagauaugcaaacauugacaccaguaggacgcuuaauuacagcaaauccaguuauuaccgaaucaacagagaauucaaaaaugauguuagaauuagauccucccuuuggagauagcuauauuguuauaggcguaggugauaaaaaaauaacacaucauuggcaucgaucaggaaguacuuuaggaaaagcauucucaacaacuuuaaaaggagcacaaagguuagcagcacuaggcgauacugcaugggacuucggaucuauaggagguguauuuaauagcaucggcagggcaguacaucaaguauuuggaggagcuuuuagaacacuauucggggguaugaguuggauaacacaaggacuaaugggcgcauuacuauuauggaugggaguaaaugcuagagaucguucaauagcacuagcauuuuuagcuacagggggaguauuaguauuuuuagcaacuaauguacacgca

SEQ ID NO: 11147 - RNA, 2100 nt, Artificial Sequence
  ZIKV (strain NatalRGN) prME-short variant CDS opt
augggccggaaacaaaauaaaagagggggaaaugaaggaucgauaauguggcuagccucauuagcaguuguaauagcaugcgccggugcgguaacacgaagaggaagugcuuacuauauguaccuagaccgaaaugaugcgggagaagcuauuaguuuuccaacaacacugggaaugaauaaauguuacauacaaauaauggaccuaggacacaugugcgaugcuacaaugaguuaugaauguccaauguuagaugaggguguagaaccagaugacguagauuguugguguaauacaacaaguacauggguaguauauggaacaugucaucacaagaaaggcgaagcaagaagaucaagacgagcaguaacauuaccaucacauucuaccagaaaauuacaaacaaggagucaaacuuggcuagagucuagagaauauacgaaacaucuaauacgaguagaaaauuggauauuuagaaauccaggauucgcauuagcagcugcagcgauagcauggcuacucggauccucaacaucacaaaaaguaauuuacuuagugaugauacuauuaauagcaccagcauauagcauuagguguauaggaguaagcaauagagauuuuguagaaggaaugaguggaggaacaugggucgacguaguauuagaacauggcggauguguaacaguaauggcacaagauaaaccaacaguagauauagaauuaguaacuacaacaguuucaaauauggcagaaguacgaucuuacugcuaugaagcaaguauuucugauauggccucagacaguagaugccccacccaaggugaagccuaucuggauaaacaaucagauacccaguacgucuguaaaagaacccuaguagauagaggauggggaaauggauguggauuauucggaaaagggaguuuaguaacaugugcaaaauuugcaugcucaaagaaaaugacuggaaaaucaauacaaccugagaacuuagaguacagaauaauguuaaguguccauggaucacaacauagugguaugauugugaaugacacaggucaugaaacagaugaaaaucgagcaaaaguagaaauaacaccaaauucaccaagagcagaggcuacauuaggagguuuuggaucguuaggacuagacugcgaaccaagaacaggacuagacuuuagugaucuauacuaucuuacuaugaacaauaaacauuggcuaguucacaaagaaugguuucaugacaucccccuacccuggcaugcaggagcugauacaggaacaccacauuggaauaauaaagaagcguuaguugaauuuaaagaugcacacgcaaaacgacaaacaguggugguauuaggaucccaagagggagcuguacauacagcacuugcaggagcacuagaagcagaaauggauggagcaaaaggaagguuaagcaguggccauuuaaaauguagacuaaaaauggauaaauuaagauuaaaagguguaucauauagcuuauguacagcagcauucacuuuuacaaaaauacccgcagaaacccuucacggaacagucaccguggaaguacaauacgcaggaacugacggaccauguaaaguaccugcucaaauggcuguagauaugcaaacucuaaccccaguuggaagauuaauuacagcaaauccaguuauaacagagucaacagaaaauucaaaaaugaugcuagaauuagauccaccauuuggugauaguuacauagugauaggaguaggagaaaagaaaauaacgcaucauuggcauagaucgggaucaacacuuggaaaagcauuuaguacaacccuaaaaggagcacaaagauuagcagcauuaggggauacugcaugggacuucgguagcauaggagguguauucaauagcauaggcagagcaguacaccaaguauucggaggagcauucagaacauuauucggaggaaugucauggauaacacaaggauuaaugggagcauuauuauuguggaugggaguaaacgcaagagacagaagcauagcauuagcauuccuagcaacaggaggaguuuuaguuuuccuggcaacaaacguacaugcg

SEQ ID NO: 11148 - RNA, 2073 nt, Artificial Sequence
  ZIKV (strain ZikaSPH2015) prME-short variant CDS opt
augaaugaaggauccauaaugugguuagccaguuuagcuguaguaaucgccugcgcuggagcaguuacacggcgaggaucagcauauuauauguauuuagacagaaacgaugcuggagaagcaauaucauuuccaacaacacuaggaaugaauaaauguuauauacaaauaauggauuugggacauaugugugacgcaacaaugaguuaugaauguccaauguuagaugaaggagucgaaccagaugauguagacugcugguguaauacaacaucaacauggguuguuuauggaacaugucaccauaagaaaggagaggcaagaagaaguaggagagcaguaacucuuccaagucacucaacucgaaaacuacaaacacgaucacaaacaugguuagaaucuagagaauauacuaaacauuugauaagaguagaaaacuggauauucagaaaucccggauuugcacuagcagcagccgcaauagcaugguuacuaggaucaaguacuucacaaaaaguaauauauuugguuaugauucuguuaaucgcuccagcauauaguauaagauguauaggagucagcaacagagauuuugucgaagguaugucaggagguacauggguugacaucguacuagaacacggcgguuguguaacgguaauggcacaagauaaaccaacaguagauauagagcuaguaaccacaacaguaucaaauauggcugaagugaggucauauuguuaugaagcaucuauuagugauauggcaucagauagucgauguccuacacaaggagaagcauauuuagauaaacaaucagacacacaauacguuuguaaaagaacucuaguagacagaggauggggaaacggauguggacuauuuggaaaaggcagccuaguaacaugcgcaaaauuugcaugcucaaagaaaaugacuggaaaaucaauacaaccagaaaauuuagaauaucgcauaaugcuuagcguacaugggucacaacacucaggaaugauaguaaacgacacuggacaugaaacugacgaaaacagagcaaaaguggaaauaacaccuaauaguccaagagcagaagcuacucuaggaggauucggaagucuaggcuuagauugugaaccuagaacgggacuagacuucucugaucuauauuacuuaacaaugaauaacaaacacuggcuuguucauaaagaaugguuucacgauaucccauuaccauggcaugcaggagcagauacaggaacaccacauuggaauaacaaagaagcauuaguagaauuuaaggaugcacaugcuaaaagacaaacaguaguaguacuggguucacaagaaggagcaguccacaccgcauuagcaggagcuuuagaagcagaaauggauggagcaaaaggacgacucucaucuggacaucuuaaaugcagacuuaagauggauaaacuaaggcuaaaaggaguaaguuauucauuauguacagcugcauuuacauuuacaaaaauacccgcagaaacauuacauggaacagugacuguagaaguacaauaugcaggcacagaugguccguguaaggucccugcacaaauggcaguugauaugcaaacauuaacaccagucgguagacuaauaacagcaaaucccguaauaacugaaucaacugaaaauucaaaaaugauguuggaauuagauccacccuucggagacucauacauuguaauaggagucggugagaagaaaauaacucaccauuggcacagaaguggaagcacacuagguaaagcauuuucaacaacauuaaaaggcgcacaaaggcuagccgcacuuggugacaccgcgugggauuuuggcucaauagguggaguauuuaauaguauaggucgugcuguacaccaaguauuuggaggcgcauuucgaacucuauuugguggaauguccuggauaacucagggacuaaugggagcacuacuacucuggaugggaguuaaugcaagagauaggucaauagcuuuagcguuucuagcaacaggugguguacucguauuccuggcaacaaacguacaugcg

SEQ ID NO: 11149 - RNA, 2073 nt, Artificial Sequence
  ZIKV (isolate Z1106033) prME-short variant CDS opt
augaaugaagguaguauaaugugguuagcaaguuuagcaguaguaauugccugugcaggagcaguaacaaggagaggaagugcauauuauauguaucuggacagaaaugacgccggagaagcgauuaguuuuccaaccacgcuaggaaugaacaaauguuacauacagaucauggauuuaggacauacaugugacgcaacaaugucauacgaaugcccaaugcuagaugaaggaguagaaccugacgauguagacuguugguguaauacuacuucaaccuggguaguauauggaacaugucaccacaagaaaggagaagcaagaagaucaaggagagcagucaccuuaccaucacauagcacaagaaaauuacaaacaagaucucaaacuuggcuugagagcagagaauacacaaaacauuuaauaagaguagaaaauuggauauuuagaaauccaggauuugcuuuagcagccgcagcgauagcaugguuacuaggaagcucaacaucccaaaaaguuauauauuuaguaaugauauuauuaauugcuccugcauauucgauaagauguauuggaguaucaaauagagauuuugucgaaggaaugagcggagggacauggguagauguuguacuagaacacgguggaugcguuacaguaauggcacaagauaaaccaacagucgauauagaauuaguuacaaccacaguaaguaacauggcagaaguaagaucguauuguuaugaggccuccauuucagauauggcaucugauucacgaugcccaacacaaggagaagcauaucuugauaaacaaucagauacccaauauguuuguaaaagaacuuuaguugacagagguuggggaaauggcuguggucuauucggcaaaggaagccuaguaacaugugccaaauucgcauguucgaagaaaaugacuggaaaaucuauucaaccugaaaacuuagaauauagaauuauguuaucagugcaugguucacaacacaguggaaugauaguaaaugacacaggacaugaaacagaugaaaacagggcaaaaguagaaauaacaccaaauucacccagagcugaagcuacauuagguggauuuggaagucucggacuagauugcgaaccaagaacaggauuagauuuuagugaucuauauuaccuaacaaugaacaacaaacauuggcuuguucacaaagaaugguuccacgauauuccccuacccuggcaugcaggagcagacacagguacaccucauuggaauaauaaagaagcauuaguagaauuuaaagaugcacaugcaaaaagacaaacaguaguaguacuaggaucucaagaaggugcaguacauacugcccuagcaggagcccucgaagcggaaauggauggagcaaaaggaagauuaucaucuggccaucuaaaaugcagauuaaaaauggacaaacuaagacuuaaaggaguaaguuauagucucuguacagcagcauuuacauuuacaaaaauuccagcagaaacuuuacaugguacuguaacaguagagguucaauaugcaggaacagauggaccauguaaaguccccgcacaaauggcgguggacaugcaaacacuaacuccaguaggaagacuaauaacagcaaauccaguaauaacagaaucaaccgaaaacucgaaaaugauguuagaauuagacccaccuuuuggugauagcuauauuguaauagguguaggagagaaaaagauaacacaccauuggcauagaagugggucaacacuaggaaaagcauuuagcacaacacuaaaaggcgcacaaagauuggcagcauuaggugacacagcuugggacuucggcagcauaggaggaguauuuaauucaauuggcagagcaguacaccaaguauuugguggagcuuuuagaacuuuauucgguggaaugaguuggauuacacaagguuuaaugggagcuuuacuacuauggauggguguaaaugcaagagauaggagcauagcauuagcauuucuagcaacagguggagugcuaguauucuuagcaacgaacguacaugca

SEQ ID NO: 11150 - RNA, 2061 nt, Artificial Sequence
  ZIKV (strain MR 766) prME-short variant CDS opt
augaaugaaggcucaauaauguggcuagcaucacuagcaguaguaauagcaugcgcuggagcuauaacuagaagaggaucagcuuacuacauguauuuagauagaagugacgcagguaaagcaauaucauuugcaacaacacuaggagucaacaaaugucauguacaaauaauggauuugggacacaugugugaugcaacaaugagcuacgaaugcccaauguuggacgaaggaguagaaccugaugauguugacuguugguguaauacaacaagcacuugggucguauaugguacaugccaucauaagaaaggagaagcaagacgaucuagacgagcaguaacacuuccgagucauucuacaagaaaauuacaaacgagaagccaaacuuggcuagaaucuagagaauauacaaaacaucuaauaaaaguagaaaauuggauauuuagaaauccaggauucgcauuaguagcaguggcaauugcauggcuauugggaagcaguacgagccaaaaaguaauauaucuaguaaugauauuacuaauagccccugcuuacagcauaagaugcauaggaguaucuaauagagauuuuguugaaggaaugucuggagguacuugggucgacguaguguuagaacauggaggauguguaacaguaauggcacaagacaaaccaacaguagacauagaauuagucacuacaacuguaucgaauauggcugagguaagaagcuauuguuaugaagcaagcauaagugauauggcauccgacaguagauguccaacucaaggagaagccuaucuagauaaacaaagugauacgcaauauguauguaaaagaacccuaguagacagaggguggggaaauggauguggauuauuuggaaaaggaagucuuguaacaugcgcaaaauucacauguucaaagaaaaugaccggaaaaagcauucaaccugaaaaucuagaguaucgaauaauguuaucuguacauggaucacaacauucaggaaugauaggauacgaaacggacgaggauagagcaaaaguagaaguaacaccaaauaguccaagggcagaagcuacauugggaggauuuggcagcuuaggauuagauugcgaaccacgcacaggauuagauuuuagcgauuuauauuauuuaacaaugaauaauaaacauuggcuaguacauaaagaaugguuucaugauauaccucuaccauggcacgcuggagcagauacaggaacaccacauuggaacaacaaagaggcgcuuguagaguucaaagacgcacacgcgaaaagacaaacaguaguuguuuuaggaagucaagaaggagcuguacacacagcauuagcaggagcuuuagaagcagaaauggacggagcaaaaggaagauuguuuaguggucaucuaaaauguagacuaaaaauggacaaauuaagauuaaaaggugucaguuauucauuauguacagcugcauucacauuuacaaaaguuccugcggaaacuuuacauggaacugucacugucgaaguacaauacgcgggaaccgauggacccugcaaaauaccuguacaaauggcuguagacaugcaaacauuaaccccaguaggaagauuaauaacagcaaauccaguaauaacagaaaguaccgaaaauucaaaaaugauguuagaacucgacccacccuuuggagauucauacauagucauaggaguaggagauaagaaaauaacacaucauuggcaucgaaguggcucaacacuagggaaagcauuuucaacuacgcuuaaaggugcacaaagauuagcagcuuuaggugacacagcaugggauuuuggaagcauaggaggaguauuuaacucaauagguagggcuguacaucaaguauuuggaggugcguuucgaacauuauucggaggaaugaguuggauaacucaaggauugaugggggcuuuacuguuauggauggguguaaaugcuagagauagaaguauugcauuggcauuuuuagcaacuggaggaguguuaguguuuuuagcaacaaauguacaugcg

SEQ ID NO: 11151 - RNA, 2073 nt, Artificial Sequence
  ZIKV (strain NatalRGN) prME-short variant CDS opt
augaaugaaggaaguaucaugugguuagcaaguuuagcaguaguaauugcaugcgcaggggcaguuaccagaagaggcagcgcuuacuauauguacuuagacagaaacgacgcaggagaagcgaucucauucccaacaacauuaggaaugaauaaauguuauauucaaauuauggacuuaggacacaugugugaugcuaccaugucauaugagugcccaaugcuugaugaaggaguggagccagacgacguugauuguuggugcaauacaaccucaacuuggguuguauauggaacaugucaucauaaaaagggagaagcaagaagaucaagaagagcaguaacacuaccuucacauucaacaagaaaauuacaaacacguucgcaaacaugguuagaaucaagagaauauacaaaacaucugauaagaguggaaaauuggauauuccgaaauccaggcuucgcauuagcagcugcggcaauugcaugguuacugggaucaucuacaagucaaaaaguaauuuacuuaguuaugauacuauuaauagcaccagcauacucaauaagguguauaggaguaagcaauagagauuucguagaaggaaugucuggcgguacguggguggacguaguacuggaacacggaggauguguuacaguaauggcacaagacaaaccgacuguugauauugaauuaguuacaacuacaguuucaaauauggcagaaguaagaucauauugcuaugaagcaucaauaucugauauggcuucagauucaagaugucccacucaaggagaagcauaucuugauaaacaaucagacacccaauacguaugcaaacgaacauuaguagauagaggauggggaaacggaugcggacuuuuuggaaaaggaagucuagucacaugugcaaaauucgcaugcaguaaaaaaaugacugguaaaucaauucaaccagaaaauuuagaauacagaauaaugcucaguguacauggaagccaacauucaggaaugauaguaaaugauacaggacacgaaacagacgaaaauagagcuaaaguugaaauaacgccaaacucacccagggcggaagcaacucuaggugguuuuggaucucuaggauuagauugcgaaccuagaacaggauuagauuucucagacuuauauuacuuaacaaugaauaauaaacauugguuaguucauaaagaaugguuucacgacauuccuuuaccauggcaugcuggagcugauacaggaacaccacauuggaauaauaaagaggcauuaguggaauucaaagacgcacaugcgaaaagacaaacaguuguaguauugggaagucaagaaggagccguccauacagcacuagcgggggccuuagaagcggaaauggauggagcaaaagguagauuaucaaguggacaucuaaaaugucgauuaaaaauggauaaauuaagguuaaaaggagucaguuacagucuauguacagcugcauucacauucacaaaaauaccagcagaaacauuacauggaacaguuacugucgaaguucaauaugcaggaacugacggaccauguaaaguaccagcucaaauggccguagauaugcaaacacuaacaccaguaggaagacuaauaacagcaaacccaguaauaacagaaucuacggaaaauucaaaaaugauguuagaguuagauccaccauucggagacagcuacauaguaauaggaguaggagaaaaaaaaauaacucaucauuggcaucgaaguggaucaacauuaggaaaagcguuuucaacaacauuaaaaggagcucaaagacuagcagcacucggagacacugcaugggauuuuggaaguauaggagggguauuuaauagcaucggaagagcaguacaucaaguauucgguggagcuuucagaacuuuauuugguggaaugaguuggauuacacaaggacugaugggcgcacuacuauuauggaugggagugaaugcaagagauagaucaauagcauuggcauuccuagcaacugguggaguacucguauuuuuggcaacaaauguacacgca

SEQ ID NO: 11152 - RNA, 2100 nt, Artificial Sequence
  ZIKV (strain ZikaSPH2015) ME variant CDS opt
augggaagaaaacaaaauaaaagaggugggaaugaaggaucaauaauguggcuagcuucacuagccguaguuauagcuugugcaggagcagugacaagaagaggaagugcauauuacauguacuuggacagaaacgaugcuggugaagccauaaguuuuccaaccacguuagguaugaauaaauguuacauucaaauaauggauuugggacauaugugugaugcuacaaugaguuaugaauguccaauguuagacgaagguguugaaccagacgauguagauugcuggugcaauacaacaaguacauggguuguauacgggacaugccaccacaagaaaggcgaagcaaggagaaguaggagagcggucacauuaccgagucauucuaccagaaaauuacaaacgagaagucaaacaugguuagaaagcagagaauauacaaaacauuuaauuagaguugaaaauuggauauuuagaaauccaggauucgcguuggcggcagcagcaauagcaugguuacucggaucaagcacaagucaaaaaguaauauaccuaguaaugauacuguuaauagcgccagcauauucaauacgauguauuggcgugagcaacagagacuuuguagaaggaaugucuggugguacauggguagauauagugcuagagcauggaggaugcgugacaguuauggcacaagauaaaccaacuguagacauagaauuaguaacaacuacaguuucaaauauggcagaaguuagaaguuauuguuaugaagcaucaauaagugacauggcaucagauuccaggugcccuacacaaggcgaagcauauuuagauaaacagucagauacacaauaugucuguaaaagaacgcuaguagauagaggauggggaaauggaugcggacuuuuugguaaaggaucauuaguaacaugcgcaaaauuugcauguucaaagaaaaugacaggaaaaucaauacaaccagaaaauuuagaauaccguauaauguuauccguacaugguagucaacauagugguaugauaguaaaugauacaggacacgaaacagaugaaaauagggcuaaaguugaaauaacaccgaacuccccacgagccgaagcuacauuaggaggauucgguagccuaggauuagauugugaaccgagaacagguuuagauuuuucagaucuauauuaucuuacaaugaacaacaaacauuggcuaguucacaaagaaugguuucaugacauaccacuuccauggcaugcaggagcagacacaggcacaccacauuggaauaauaaagaagcucuaguagaauuuaaagacgcucaugcaaagagacaaacaguuguaguccuaggaagucaagaaggugcaguucacacagcacuagcaggagcucuagaagcugaaauggauggagcgaaagguagacuaucaagcggacaccuuaaauguagguuaaaaauggauaaauuaagauugaagggaguaaguuauagcuuaugcaccgcugcauuuacauucaccaaaauaccggcagaaacuuuacauggcacgguuacaguagaaguccaauaugcaggaacggauggaccaugcaaaguacccgcacaaauggcaguagauaugcaaacauuaacuccuguaggccgacuuauaacggcaaauccuguuauaacagaaaguacugaaaauucaaaaaugauguuagaacuagacccuccauucggagauaguuauauaguaauuggaguaggagaaaagaaaauaacgcaucauuggcauagaagcggaucaacuauagguaaagcauuugaagcaacaguacgaggagcaaaaagaauggcaguacuaggagauacggcaugggauuuugguucaguaggaggagcauuaaauucauuaggaaaaggaauacaccaaauauuuggagcagcauuuaaaaguuuauucggaggaaugucaugguucagucaaauacuaauaggaacucuacuaauguggcuagguuuaaauaccaaaaaugguucaauaucauuaauguguuuagcuuuaggggguguauuaauauuucuaucuacagcuguauccgcu

SEQ ID NO: 11153 - RNA, 2100 nt, Artificial Sequence
  ZIKV (isolate Z1106033) ME variant CDS opt
auggggagaaaacaaaauaaaagaggaggaaacgaaggaaguauuaugugguuagcuucauuagcagucguaauagcuugugcuggagcaguaacuagaagaggcucagccuacuauauguauuuggaccgaaaugaugcuggugaagcaaucucuuucccaacuacuuuagggaugaacaaauguuauauacaaauaauggaucuuggacauacaugugaugcgacaaugucauaugaauguccaaugcuagaugaaggaguggaaccugaugacguagauuguugguguaauacuacaucaacauggguagucuaugguacaugucaccauaagaaaggagaagcacgaaggucacgcagagcaguaacauuaccaucacacucaacaagaaaauuacagacaagaagccaaacauggcuagaaaguagagaauauacaaaacauuuaauaagaguagaaaacuggauuuuuagaaacccaggauuugcauuagcagcagcagcaauagcauggcuauuagguucaucaaccagucaaaaagugauauaucugguaaugauauuauuaauagcaccagcauauucaauaagaugcauuggaguaucaaauagagauuuuguugaaggcauguccggaggaacauggguagacguaguccuagaacauggagguugcguaacagucauggcucaagauaaaccuaccgucgacauagaauuaguaacuacaacaguaucaaauauggcugaaguacgaagcuauugcuacgaagcaaguauuucagauauggcaucagacaguagaugcccaacucaaggugaagcauauuuagacaaacaaagugauacacaauauguauguaaaagaacucucguagaucggggauggggaaauggaugcggacuuuuuggcaaaggcucacuugugacuugugcaaaauuugcguguaguaagaaaaugacaggaaaaucaauacaaccggaaaauuuagaauaucgaaucauguugucaguacacggaucacaacauagcggcaugauagucaaugauacgggacaugaaacugaugaaaauagagcuaaaguagaaauaacaccaaauucaccaagagcagaggcgacauuaggaggauuuggaucacuaggacuagauugugaaccaaggacaggauuagacuuuagugaccuauauuauuuaacuaugaacaauaaacauuggcuaguacauaaagaaugguuccacgauauaccuuuaccauggcaugcaggagcagauacgggaacaccccauuggaauaauaaagaagcacucguagaguucaaagaugcacacgcaaaaagacaaacaguaguaguauuaggaagucaagaaggugcaguacauacugcauuagcaggagcauuggaagcagaaauggacggagcaaaaggucguuugucaucaggacauuuaaaguguagauuaaaaauggauaaauuaagacuuaaaggagucaguuauucguuauguacagcugcauuuacauucacaaaaauaccagcugaaacacugcacggaacaguaacgguagaaguacaauacgcaggaacggacggaccguguaaaguuccugcacagauggcaguagauaugcagacacuuacuccaguagguagguuaauaacugcaaauccagucaucacagaaucuacagaaaauaguaaaaugauguuagaauuagaucccccauuuggagauucauauauaguaauagggguuggcgaaaagaaaauaacacaucauuggcauagaucaggaucaaccauaggaaaagcauuugaagcaacaguaagaggugcaaaaagaauggcagugcuaggcgacacagcaugggauuuuggaucaguaggaggagcacuaaacagccuaggaaaagguauacaucaaauauuuggagcugccuuuaaaaguuuauucggaggaaugucuugguuuagucaaaucuugauaggaacucuauuaaugugguuaggauugaaugcgaaaaauggaucaauuucacuaauguguuuagcauuaggagggguuuuaauauuuuuaaguacagcagugagugcu

SEQ ID NO: 11154 - RNA, 2088 nt, Artificial Sequence
  ZIKV (strain MR 766) ME variant CDS opt
augggacgaaaacaaaacaaaagaggagggaaugaaggcucgauaaugugguuagcaucuuuagcaguagucauugcaugugcuggagcaauuacaagaagagguucagcuuauuacauguaccucgauagaagcgacgcagggaaagcaauuucauucgcgacaacauuaggaguaaauaaaugucauguucaaaucauggacuuaggucacaugugcgacgcaacaaugagcuacgaauguccaauguuggacgaaggcguggaaccagaugauguagauuguugguguaauacuacaucaacaugggugguauauggcacuugccaucauaagaaaggagaagcaaggagaucaaggagagcgguaacccuaccaagucauaguacuagaaaauuacaaacuagaagccaaacauggcuugaaaguagagaauacacaaaacauuuaauaaaaguugaaaauuggauauuuagaaauccaggauuugcauuaguagcaguagcaauugcuugguuauuagguagcagcacaagccaaaaaguaauauaccuaguaaugauauuauuaauagcaccagcguacaguaucagauguauaggaguaagcaauagggacuuuguagaaggaaugucaggaggaacguggguagauguaguacuagaacaugguggauguguaacaguaauggcacaagauaaaccaacaguagacauagaacuuguuacaacuacaguaaguaacauggcagaaguaagaagcuacuguuacgaagcgucuauaucagauauggcaucagauucaagauguccaacacaaggagaagcauacuuagauaaacaaucggacacucaauauguaugcaaaagaacccuaguagauagaggauggggaaauggaugcgggcuauucggaaaaggaucauuaguuacaugugcaaaauuuacauguaguaagaaaaugacaggaaaaucaauacaaccagaaaacuuagaauauagaauaauguuaaguguucauggaucacaacauuccgggaugauuggcuaugagacagaugaagacagggcaaagguagaaguuacaccaaauucaccccgagcagaagcuacuuuaggaggauuugguagccugggauuagacugugaaccuagaacgggauuggauuuuagugauuuauauuaucuaacaaugaauaauaaacauugguuaguccauaaagaaugguuucacgacauaccauuaccauggcacgcaggggcugacacaggaaccccacauuggaauaauaaagaagcauuaguugaauuuaaagacgcgcaugcaaaaagacaaacaguaguaguguuaggaagccaagaaggagcagugcauaccgcucuagcgggagcacuagaagcagaaauggauggagcaaaaggaagguuauuuucaggacaucuaaaauguagacuaaaaauggauaagcuaaggcuuaaggggguaaguuauaguuuauguacagcagcuuucacauuuaccaaaguaccagcggaaacguuacauggaacgguaacaguagaaguacaauaugcaggaacagauggcccguguaaaauaccgguucaaauggcaguagacaugcaaacauugacacccguugguagauuaauaacagcaaauccaguaauaaccgaaucuacagaaaacucaaagaugaugcuugagcuagauccaccauuuggagacagcuauauuguaauagguguaggggauaagaaaauuacacaucauuggcaucgaaguggaucgacuauagguaaagcauuugaagcuacaguaagaggugcaaaaagaauggcaguuuuaggagauacagcaugggacuuuggaaguguuggggguguuuuuaauucacuagguaaagggauacaucaaauauuuggagcugcauucaaaucauuauuugguggaaugucaugguuuucacagauacugauaggaacacuauuaguaugguuaggguuaaauaccaaaaaugguucaauaaguuugacaugucuagcauugggaggagucaugauauuucuuaguacagcuguaagcgcu

SEQ ID NO: 11155 - RNA, 2100 nt, Artificial Sequence
  ZIKV (strain NatalRGN) ME variant CDS opt
augggcaggaaacaaaauaaaagaggaggcaaugaaggaaguauuaugugguuagcaucauuagcggucguuauagcaugugcaggcgcaguaacaagacguggaagugcauauuacauguauuuggacagaaaugaugcaggagaagcaauaagcuuccccacaacgcuaggaaugaauaaauguuauauacaaauaauggauuuaggacacaugugugacgcaacaaugucuuaugaauguccaauguuggaugaaggaguagaaccagaugauguagauugcugguguaauacuacaaguacauggguaguuuauggaacaugccaucauaaaaaaggcgaagcaagacgaagcagaagagcggucacacuaccuucacauucaacccgaaaauuacagacaagaagccagacauggcuugaaucaagggaauauacaaaacacuuaaucagaguggaaaacuggauauuuagaaauccaggauuugccuuggccgcagcagcaaucgcauggcuacuuggaucaaguacuagucaaaaagucauauaucucguaaugauacuuuuaauagcaccagcuuauaguauaagauguauaggagucucaaauagagacuuuguagaaggaaugucaggaggaacauggguagacguaguauuagaacaugguggauguguaacaguaauggcucaagacaaaccaacaguagauaucgaauuaguaacuacaacugugagcaacauggcagaaguuagaucauauugcuaugaagcaucuauaucugacauggcuucagauucccgauguccaacacaaggagaggcuuauuuagauaaacaaucugacacacaauauguauguaaaaggacuuuaguagauagaggauggggaaaugguugcgggcuauuuggaaaaggcucguuaguaacaugugccaaauucgccugcaguaaaaaaaugacaggaaaaucaauacaaccugaaaauuuagaauauagaauaauguugucaguacauggaucucaacauucggggaugauaguaaacgauacaggacacgaaacagacgaaaauagagcaaaaguugagauaacaccaaauucaccucgagcagaagcaacacuggggggguuuggaagucucggauuggacugugaaccaagaaccggacuagauuuuucagauuuauauuauuugacaaugaacaauaaacacugguuaguacauaaagaaugguuccaugauauaccacuacccuggcaugcaggagcagauacagguaccccacacuggaauaauaaagaagcacuaguagaauuuaaagaugcacacgcaaaaagacaaacaguaguaguauuaggcucacaagaaggagcaguccacacugcacucgcaggugcgcuagaagcugaaauggauggagcaaaaggcagauuaagcaguggacacuuaaaauguagacucaaaauggauaaauuaagacuaaaaggcguaaguuauagucuauguacagcagcauucacauucacaaaaaucccagcagaaacacuacauggaacagucacaguagaaguacaauaugcuggaacagauggaccauguaaaguuccagcacaaauggcaguugacaugcagacacuaacaccaguaggacgacuaaucacagcaaauccagucauaacugagucaacagaaaauaguaaaaugauguuagaauuagauccuccauuuggugauucauauauaguaauuggaguuggagaaaaaaaaauaacgcaucauuggcacagaaguggaucgacaauaggaaaagccuuugaagcaacgguaagaggggcuaagaggauggcugugcuaggagauaccgccugggauuucgguuccguaggaggagcacuuaacagcuuagguaaaggaauucaucaaauuuuuggugcugccuucaaaucauuguuuggaggaaugucaugguucucacagauauuaauagguacguuguuaauguggcuuggauuaaacacaaaaaaugguucuauaagcuuaaugugcuuagcauuaggaggaguauuaauauuucucucaacagccguuagugca

SEQ ID NO: 11156 - RNA, 2073 nt, Artificial Sequence
  ZIKV (strain ZikaSPH2015) ME variant CDS opt
augaaugaagguucaauaaugugguuagcaucauuagcaguugugauagcaugcgcaggcgcagucacaaggagaggcucugcuuauuacauguauuuagaucgaaaugaugcaggggaggcaauaaguuuuccaaccacacuuggaaugaacaaauguuauauacaaauaauggauuuaggacauaugugcgaugcaacuaugucauacgaauguccaauguuagaugaaggagucgaaccagaugacguggauugcugguguaauacaacgagcacguggguaguauauggaacuugucaccauaaaaaaggagaagcuagacgaagcagaagagcaguaacauuaccaagucauagcacacguaaacuccaaacacgaucacaaaccugguuagagagcagagaauauacuaaacacuuaauaaggguagaaaauuggauuuuuagaaauccuggauucgcauuagcggccgcugcaauagcaugguuauugggaaguucgacaagccaaaaagucauauauuuaguaaugauuuuauuaauagccccagcauauucaauaagauguauaggcguaucaaauagagauuuuguagaagggaugaguggaggaacauggguagauauaguucuagaacauggaggaugcguaacagucauggcucaagauaaaccuacaguugacauagaacuaguaacaacaacaguaucaaauauggcagaaguaagaagcuacuguuaugaagcuucaaucucggacauggcaucagauucaagauguccaacgcaaggagaagcuuauuuggacaaacaaagcgacacccaauaugucuguaaaagaacauuaguggauaggggaugggguaauggauguggccuauuuggaaaaggaagccuaguaacaugugcaaaauuugcaugcaguaaaaaaaugacuggaaaaucaauucaaccagaaaaccucgaauauaggauaauguuaaguguacauggaagucaacacaguggaaugauaguuaaugauacaggccaugaaacagacgaaaacagagccaaaguagaaauaacuccaaauucaccacgagcggaagcgacacuaggaggauuugggucauuaggauuagauugcgaaccaaggacaggauuagauuucagugauuuauauuauuuaacaaugaacaauaaacauugguuaguacacaaagaaugguuucacgacauaccccucccauggcaugcaggagccgauacagggacuccucauuggaacaauaaagaagcguuaguagaauuuaaagaugcucacgcuaaaagacaaacaguuguaguacuaggaucgcaggaaggagcagugcauacagcauuagcaggugcacuagaagcagaaauggauggcgcaaaaggaagacuaaguucaggacauuuaaaauguagauuaaaaauggauaaauuaagauuaaaaggaguuucuuauagucuaugcacugcagcuuuuacauuuacaaaaauaccggcagaaacgcuacaugggacaguuaccguagaaguucaauacgcaggaaccgacggcccaugcaaaguaccagcacaaauggcuguugauaugcaaacauuaacaccgguuggaagacucauaacagcuaauccaguaauaacagaaucaacagaaaacucaaaaaugauguuagaauuagauccuccauucggagacaguuacauaguaauaggugugggagaaaaaaaaauaacccaucauuggcacagaaguggaaguacaauaggaaaagcauucgaagcuacuguacgaggcgcgaaaaggauggcgguauuaggagauacagcaugggacuuuggaucgguaggaggagcauuaaauucauuagguaaaggaauacaucaaauauuuggagcugcauuuaaaaguuuauuugguggaaugagcugguuuagucaaauauuaauaggaacauuauuaaugugguuagggcuaaauaccaaaaauggaucaauaagucuaaugugucuagcauuagguggugugcuuauauuuuuaaguacagcagucagugca

SEQ ID NO: 11157 - RNA, 2073 nt, Artificial Sequence
  ZIKV (isolate Z1106033) ME variant CDS opt
augaacgaaggaagcauaaugugguuggcaucauuagcaguagucauagcaugugcaggagcgguaacaagaaggggaagugcuuauuauauguauuuagauagaaaugaugcaggagaagcaauaucauuuccuacaacacuaggcaugaacaaaugcuauauacaaauaauggauuuaggacauacaugugaugcaaccaugagcuacgaaugucccauguuagacgaaggaguagaaccagaugauguagauugcugguguaacacuaccucaacauggguaguauacggaacaugucaucauaagaaaggagaagcaagaaggagccguagagcaguaacauuaccaagucauagcacaagaaaacuacaaacacguagccagacauggcuggaaucuagagaauauacaaaacauuuaauaagaguugaaaauuggauauuuagaaauccuggauuugcauuggcugcggcugcaauagccugguuacuaggaucaucaacaucucaaaaaguuaucuauuuaguaaugauacuacuaauagcaccagcuuauucaauacgaugcauaggaguuucaaacagagacuucguugaaggcauguccgguggcacauggguagauguaguacuagaacacggaggaugcguaacaguaauggcacaagauaaaccaacuguagauaucgaauugguaacaaccacagugucaaauauggcugagguaagaagcuacuguuaugaagcaucaauuucagauauggcaagugacucacguuguccgacacaaggugaagcauaucuagauaaacaaucagauacacaauauguuuguaaacgaacauuaguagaccgagguuggggaaaugguugcggacuauuuggaaaagguucacuggucacaugcgcgaaauuugcaugcucaaagaaaaugacaggaaaaaguauacaaccugaaaaucuggaauauagaauuauguuaucaguucauggcucucaacacucaggaaugauaguaaacgauacuggucaugaaacugaugaaaauagagcuaaaguugaaauaacaccaaacaguccgcgagcggaagcaacauuaggcggauuuggaagucuuggacuagacugugaaccgagaacaggauuagacuuuagugauuuauacuaucuaacaaugaacaauaaacauugguuaguacacaaagaaugguuucacgauaucccuuuaccauggcacgcaggagcugacacaggaacgccucauuggaauaacaaagaagcauuaguagaauuuaaagacgcgcaugcaaaacgacaaacaguaguaguacuagggucacaagaaggagcaguacauacugcauuagcaggagcauuagaagcagaaauggacggagccaaagguagauuaagcagcggacaucuaaaaugcagacuaaagauggauaaauuaaggcuaaaaggaguaucuuacagccuguguacagcugcauucacauuuacuaaaauuccagcagaaacauuacauggaacaguuaccguagaagugcaauaugcaggaacagauggcccauguaaaguaccagcucaaauggcuguugauaugcaaaccuuaacgcccguuggacgacuaauaacugcaaaucccguaauaacagaaaguacagaaaacuccaaaaugaugcuugaauuagauccaccauuuggagauucuuauauuguaauagguguaggugaaaagaaaauuacacaucacuggcacagaaguggaucaacaauaggaaaagcauuugaagcaacaguccgaggugcaaaaagaauggcaguacuaggagauaccgcuugggauuuugguucaguagguggagccuuaaacaguuuaggaaaaggaauacaccaaauauuuggagcagcauuuaaaucauuauucggaggaaugaguugguuuagccaaauauugauugguacgcuguuaauguggcuaggacuaaaugcaaagaauggaaguauaucauuaaugugcuuagcccuuggaggaguauuaauuuuucucaguacagcagucucagca

SEQ ID NO: 11158 - RNA, 2061 nt, Artificial Sequence
  ZIKV (strain MR 766) ME variant CDS opt
augaaugaagguagcauaaugugguuagcaaguuuagcaguaguaauugcuugcgccggagcaaucacgagacgaggaucagcauacuauauguacuuagauagaagcgaugcaggaaaagcuauaagcuuugcuacaacauuaggaguaaauaagugucaugugcaaauaauggacuugggacauaugugugaugcaaccaugucuuaugaauguccaauguuagaugaaggaguagaaccugacgauguagauugcugguguaauacaacaucaacauggguuguauacggaacgugccaccauaaaaaaggagaagcaaggagaucaagaagagccguaacacuaccaagucacucaacacgaaaacuacaaacaagaagucaaacaugguuagaaagcagagaauauacaaaacauuuaauaaaaguagaaaauuggauauucaggaauccagguuuugcuuuaguugcaguagcuauagcuuggcuauuaggaagcagcacgucacaaaaaguuauuuaucuaguaaugauacuacugauagcaccagcguacucaauaagaugcauuggaguuucaaauagagauuuuguagaaggaaugagcggaggaacuuggguagacguaguucuagaacaugggggaugcguaacaguuauggcacaagacaaaccaacaguagauaucgaacuaguaacaacuacaguaucaaauauggcagaaguacgaaguuauugcuacgaagcaucaaucucggauauggcaagugauagucguuguccgacacaaggcgaagcauacuuagauaaacaaagugauacgcaauaugucuguaaaagaacauuaguagacagaggguggggaaauggaugcggacuauuugguaaaggauccuuaguaacaugcgcuaaauucacuugcucuaaaaaaaugacagggaaaaguauacaaccugaaaaccuggaauaucgaauaauguuaucaguucauggaucacaacauucaggaaugauaggauacgaaacggaugaagauagagcaaaaguagaaguaaccccaaauaguccuagagcugaagcuacacuaggagguuuuggcucacuaggauuagauugugagcccagaacaggacucgauuucagugaucuauauuauuuaacaaugaauaauaagcauuggcuaguacacaaagaaugguuucaugacauaccucugccauggcaugcaggagcagauacaggaacaccccacuggaauaauaaagaagcuuuagucgaauucaaagacgcucacgcaaaaagacagacaguugucguuuuaggaagucaagaaggagcaguacauacagcucuagcuggugcauuagaagcagaaauggauggugcaaaaggaagauuauuuagcggacaucuaaaaugucgauuaaaaauggauaaauuaagauuaaaagggguaucauauagucuauguacagcagcauucacauuuacgaaaguaccggcagagacauuacauggaacaguaacaguugagguccaauacgcaggaacagacggacccuguaaaauaccugugcaaauggccguagacaugcaaacguuaacuccaguaggaagacuaaucaccgcaaauccaguaauaacugaaucaacugaaaauaguaaaaugaugcuugaauuagauccaccauucggagauucauauauaguaauuggaguuggugauaaaaaaaucacacaucauuggcauagaucagggucaacaauaggaaaagcauucgaggcgacaguaagaggagcuaaaagaauggcuguucuaggagauacagcaugggauuucggcagcguaggcgguguauucaacagcuuaggaaaagggauacaucaaauauuuggcgcagcauuuaaaagucuauuuggugguaugucgugguuuucacaaauacuaauaggaacccuauuaguuugguuaggacuaaauacaaaaaacggaucaauaucucuaacaugcuuagcauuaggaggagugaugauuuuucuaagcacagcaguaagcgca

SEQ ID NO: 11159 - RNA, 2073 nt, Artificial Sequence
  ZIKV (strain NatalRGN) ME variant CDS opt
augaacgaaggaaguauaaugugguuagcaaguuuagcagucguaauagcaugugcgggagcaguaacuagaaggggaagugcauauuauauguaccuagauaggaaugacgcuggugaagcaauaucauuuccaacuacuuuagggaugaauaaaugcuauauacaaauaauggauuuaggucauaugugugaugcaacaaugaguuaugaauguccaauguuggacgaaggaguagaaccagaugacgucgauuguugguguaauacaacaagcacauggguaguuuacggaacgugucaccacaagaaaggagaggcaagacgaaguagacgagcagucacauuaccaagccacaguacaagaaaacuucaaacuagaagucaaaccuggcuagaaucaagagaguacacaaaacaccuaauaagaguagaaaauuggauauuuagaaauccaggauuugcucuagcagcagcagcaauagcaugguuacuaggaagcaguacaagucaaaaaguuauauaucuaguaaugaucuuauuaauagcucccgcguacucgauaagauguauuggagugaguaauagagauuuuguagaaggcaugucaggcgguaccuggguagauguagugcuagaacauggaggaugcguaacaguaauggcacaagauaagccaacaguagauauagagcuaguaacgacaacaguuucuaauauggcagaaguuagaaguuauugcuaugaagcuaguauaucagacauggcaagcgacaguagaugcccaacacaaggagaagcauauuuagauaaacaaagugauacacaauaugucugcaaacgaacucuaguagacagaggguggggaaaugguuguggauuauucgggaaaggaucauuaguuacaugcgcuaaauuugcauguagcaagaaaaugacaggcaaaaguauacaaccagaaaauuuagaauauagaauaauguuaucaguacacgggucgcaacauaguggaaugauuguuaaugacacaggccaugaaacagaugaaaacagggcgaaagucgaaauaacaccaaacuccccaagggcagaagcaacauuaggaggauuuggaagucuaggucuagacugugaaccaagaacugguuuagauuuuagugaucuauauuacuuaacuaugaauaacaaacauuggcuagugcauaaagaaugguuucaugauauacccuuaccauggcaugcaggagcagauacaggcacaccucauuggaauaauaaagaagcauugguagaauuuaaagaugcacacgcaaaacgccaaacaguaguaguacuaggaucacaagaaggugccguacauacagcacuagcuggugcacuugaagcagagauggauggcgcuaaaggacgauuaucaucaggacaccuaaaaugucgacugaaaauggauaaacuaagacuaaaagggguaaguuauucacuauguacagcagcauuuaccuuuaccaaaauaccagcugaaacauuacauggaacuguaacuguagagguacaauaugccgguacugauggaccauguaaaguaccagcacaaauggcaguagauaugcaaacauuaacgccaguaggaagauugauaacagcgaauccaguaauaacagaauccacagaaaacucaaaaaugaugcuagaauuagauccaccuuuuggagauucuuauauaguaaucggaguuggagaaaagaaaauaacucaucauuggcacagaucaggaaguacaauagguaaagcauuugaagccaccguaagaggagcuaaaagaauggcaguauuaggagauacagcaugggauuuugguaguguaggaggugcacuaaauucacuagguaaagggauacaucaaauauuuggggcagccuuuaaaucauuauuuggaggaaugaguugguuuucucaaauauuaauaggaacuuuauuaaugugguuaggacucaacacuaaaaacggaagcauaaguuuaauguguuuagcacuuggaggaguacuaauuuuucuaagcacagcaguaucagca

SEQ ID NO: 11160 - RNA, 2100 nt, Artificial Sequence
  ZIKV (strain ZikaSPH2015) prME-short variant CDS opt
augggacggaaacaaaacaaaagaggaggcaacgaaggcucaauaauguggcucgcaagccuagcaguaguaaucgcaugcgccggggcgguaacacgacgcggcucagcauacuacauguaccuggaccgcaacgacgccggcgaagcuauauccuuccccaccacgcucggaaugaacaaaugcuacauacaaauaauggaccuuggccacaugugcgacgcaacaauguccuacgaaugccccaugcuggacgaaggaguagaaccggacgacguagauugcuggugcaacaccacgaguaccugggucguauacggcacaugccaccacaaaaagggcgaagcacgccgaagccgacgagccgucacccugcccagccacagcacccgcaaacuccagacccgcagccaaaccuggcuggaaagccgagaauacaccaaacacuuaaucagagucgaaaacuggaucuucagaaaccccggauucgcucucgcagccgccgcaauagcauggcugcucggcucguccacaucacaaaaagucaucuaccuaguaaugauccuccugaucgccccagccuacagcauccgcugcauaggaguaagcaaccgugacuucguggaaggaaugucaggaggcaccuggguagacauaguccucgaacacggaggcugcgucacaguaauggcacaagacaaaccaaccgucgacaucgaacucguaaccacaaccguauccaacauggcggaggucagauccuacugcuacgaagccagcaucagcgacauggccuccgacuccagguguccaacccagggagaagcauaccucgacaaacaaucugacacccaauacgucugcaaacgaacccuagucgaccgaggguggggcaacggcugcggacuguucgggaaaggaagucuaguuacaugcgcaaaauucgccugcagcaaaaagaugacaggaaaaucaauacagccagagaaucucgaguacagaauaaugcucuccguccacggcucacaacacucaggcaugauaguaaacgacacgggacacgaaacagacgaaaacagagcaaaggucgagaucacacccaacagcccacgugcggaagcaacacugggaggcuuuggcagccuaggacuggacugcgaaccccgcaccggccucgacuucagcgaucucuacuaccucacgaugaacaacaagcacuggcugguccacaaggaaugguuucaugacauaccacuaccauggcacgcaggcgccgacacagggacaccccacuggaacaacaaagaagcacuggucgaguucaaagacgcgcacgccaaaagacaaaccguaguaguccuaggcucccaagaaggagcaguccacacggcacuagccggcgcgcucgaagcggaaauggacggagccaaaggaagacuaaguucaggacaccuaaaaugcagacuaaaaauggacaaguuacgacugaaaggagucucguacagccucugcacggcagccuucacauucaccaagauaccagcagaaacccuacacggcaccguaacggucgagguacaauacgccggaaccgacggaccaugcaaagucccagcacaaauggcagucgacaugcaaacccuaacacccgucggccggcuuaucacagcaaacccgguaaucacagaaaguacagagaacuccaaaaugaugcucgaacucgacccgcccuucggagacagcuacaucgucaucggcgucggcgagaagaaaaucacacaccacuggcaccggagcggaucaacgaucggcaaagcauucgaagccacaguaagaggugcaaaacgaauggccguccuaggggauacagcaugggacuucggcagcguaggcggcgcacugaacagccuugggaaaggcauacaccaaaucuucggagcagcauucaaaagccuguucggaggcaugagcugguucucucaaauccuaauaggaacccuccucauguggcucggccuaaacaccaaaaauggaagcaucagccucaugugccuagcacuaggaggcguccuaaucuuccugaguacagccguaagcgcc

SEQ ID NO: 11161 - RNA, 2100 nt, Artificial Sequence
  ZIKV (isolate Z1106033) prME-short variant CDS opt
augggccgaaaacaaaacaaacgcggaggcaacgaaggauccauaauguggcuagcuucccuggccguuguaauagcgugcgcuggcgccgucacacgacgaggauccgccuauuacauguaccucgaccgcaacgacgccggagaagcaauaucauucccgacaacccuugggaugaacaaaugcuacauacagaucauggaccucggacauaccugcgacgcaaccauguccuacgaaugcccaaugcuagacgagggagucgagccagacgacguggacugcuggugcaacaccacaagcacaugggugguauacggaaccugccaccacaagaaaggcgaagcccgucgaagcaggcgagcagugaccuuaccaagccacagcaccagaaaacuccagacacgcucacaaacauggcucgaaagcagggaauacacgaaacaccuaaucaggguagaaaacuggaucuuccgaaacccaggcuucgcccucgccgccgcagcaaucgcauggcuacuaggcucgagcacaagccaaaaagucaucuaucucgucaugauacuccuaauagcacccgcauacucaauacgaugcauaggugucagcaaccgcgacuucgucgaaggaaugagcggaggaaccuggguagacguaguccucgaacacggcggauguguaacagucauggcccaagacaaaccuacagucgacauagagcuaguaaccacgaccguaagcaacauggcagaaguacgaagcuacugcuacgaagccucgaucagcgacauggcaagcgacucccgcugcccaacccagggagaagcauaccuggacaaacaaagcgacacacaauacgucugcaaacggacacucgucgaccgcggauggggaaacggcugcggacuauucggcaaaggcagccuaguaacaugugcaaaauucgccuguuccaagaaaaugaccgggaaaucaauacaaccggaaaaccuagaauaccgaauaaugcucagcgugcacggaucacaacacucugggaugauaguaaaugacaccggccacgaaacugacgaaaaccgcgccaaaguagagaucacccccaacucgccccgcgcagaagccacacuaggcggcuucggaucccugggccucgacugcgaaccacgaacgggacuagacuucucagaucucuacuaccucaccaugaacaacaaacacuggcuaguccacaaagaaugguuccacgacaucccacuccccuggcacgccggagcagauaccggaaccccgcacuggaacaacaaagaagcgcuagucgaguucaaagacgcacacgcaaaaagacaaacggucgugguacuaggcucccaagaaggcgcaguccacaccgcucuggccggugcacuggaagcggaaauggauggcgcuaaaggccgccucucaagcggccaccucaaaugccgacuaaaaauggacaaacuacgccucaaaggggucagcuacagccuaugcacagcagccuucaccuuuaccaaaauaccagcagaaacccuacacgguacaguaaccguugaagugcaauaugcaggaacagacggacccugcaaagucccggcacaaauggcagucgacaugcagacccugacaccaguaggccgacuuaucacagccaacccagucaucaccgagucaacagaaaacuccaaaaugaugcucgagcuagacccaccauucggagauagcuacaucguaaucgggguaggggaaaagaagauaacacaccauuggcacagaagcggcagcacuauaggaaaagcauucgaagccacagugaggggagcaaaacgcauggccgugcucggcgacacagcaugggacuucggcuccguaggcggcgcccugaacagccugggaaaaggaauacaccaaauauucggagcggcauucaagucccuauucggcggcaugucaugguucucacaaauacugaucggcacacugcuaauguggcuaggccucaaugcuaagaacggcagcauaagccucaugugccuagcgcucgggggaguacuaaucuuucuaaguaccgccgugagcgca

SEQ ID NO: 11162 - RNA, 2088 nt, Artificial Sequence
  ZIKV (strain MR 766) prME-short variant CDS opt
augggccguaaacaaaacaaacgaggaggcaacgaaggaagcauaauguggcuagccucccucgcaguaguaauagccugcgccggcgcaaucacccgccgaggcucggccuacuacauguaccuagacaggagugacgcaggcaaagccaucagcuucgcaacaacccucgggguaaacaaaugccacguacaaaucauggaccucggacacaugugcgacgccacgaugucauacgaaugccccaugcuagacgaaggagucgaacccgacgacguagacugcuggugcaacacaaccagcacgugggugguauacggaacaugccaccacaagaaaggagaagcacgaaggagcagaagggcagugacccuaccgagccacuccacccgcaaacuccaaacacggagccaaacauggcucgaaagccgagaauacacaaaacaccucauaaagguagaaaacuggaucuuccgcaacccaggcuucgcccuagucgccguagcaauagccuggcuacuagguuccagcacaucccagaaggucauauaccuggucaugauauuacuaauagcgccggcauacagcauucgaugcauaggcguaagcaaccgagacuucguagaaggcauguccggcggaaccugggucgacgucguacucgagcacggagggugcguaaccgugauggcccaagauaagcccacagucgacauagaacucguaaccaccacggucaguaacauggcagaagugagauccuacugcuacgaagcguccauaagcgacauggccucagacagccgauguccaacccaaggggaagccuaccuggacaaacaaucagacacucaauacgucuguaagagaacccuagucgacagaggauggggcaacggaugcggacuauucggcaaaggcucacucgucacaugcgcaaaauucacaugcuccaagaagaugacaggaaaaagcauacaaccagaaaaccucgaguacagaauaaugcucuccgugcacggcucacaacacagcggaaugaucggcuacgaaacugacgaagaccgcgcaaaaguggaggugacacccaacucaccccgcgcagaagccacccucggcggauucggcagccucggccuagauugcgagccacgaacaggccuagacuucagugaccuauacuaccuaacaaugaacaacaaacacugguuagugcacaaagaaugguuccacgauaucccacuacccuggcacgcaggcgccgacacagggaccccacacuggaacaacaaagaggcccucguagaguucaaagacgcacacgccaaacgacagacaguaguaguacugggaucucaggaaggcgcggugcacaccgcacuagcgggcgcccuggaagccgaaauggacggagcaaaaggacgccucuucuccggacaccugaaaugcagacucaaaauggacaaacugcgccucaaaggcgucagcuacagccugugcaccgcagcauuuaccuucacaaaagucccugcagaaacacuccacggaacagugacaguagaaguacaauacgccggcacagauggcccaugcaaaauacccguccagauggccgucgacaugcaaacccuuaccccagucggacgccucaucacagcaaacccggucauaaccgaauccacagaaaacucgaaaaugaugcuggaacucgacccacccuucggcgacaguuacauaguaaucgguguaggagacaagaaaaucacacaccacuggcaccgcagcggcucaacuaucggcaaagcauucgaggccacagucagaggcgcaaaacgaauggcuguccuaggcgacacagccugggauuucggcagcguaggcggcgucuucaacucccucggcaaaggaauacaccaaauuuucggggccgcauucaaaucacucuucggaggaaugucaugguucucgcaaauccucauaggcacccuccuaguauggcucggacucaauaccaaaaacggaucaaucagccuaaccugucuugccuuaggaggaguaaugaucuuccucagcaccgcagucagcgca

SEQ ID NO: 11163 - RNA, 2100 nt, Artificial Sequence
  ZIKV (strain NatalRGN) prME-short variant CDS opt
augggccgaaagcaaaacaaacgcggcggcaacgaaggaucaaucauguggcucgccucccucgcaguaguuaucgccugcgccggcgccgucacgcgacgcggcucagcauacuacauguaccuggaccgaaacgacgcaggcgaagccauauccuuccccaccacccucggaaugaacaagugcuacauucaaaucauggaccugggucacaugugugacgccacaauguccuacgaaugcccaaugcuggacgaaggcgucgaaccagacgacgucgacugcuggugcaacacuacaucaacauggguaguauacgggaccugccaccacaagaaaggcgaagcacgacgcuccagacgagcagucacacugcccucccacuccacccgaaaacuacagacacggucccaaacauggcucgaaagcagggaauauaccaaacaccuaauccgcgucgagaacuggauauuucgaaaccccggcuucgcacucgccgccgccgccaucgccuggcuccuaggauccagcacaucacaaaaagucauauaccucguaaugauacuacucauagcgcccgcauacagcauaagauguaucggcguaagcaaccgagacuucguagaaggcaugucaggaggcacaugggucgauguaguccuagaacacggaggcugcguaacagucauggcccaagacaaaccaaccgucgacauagagcuagugacaaccaccguaucaaacauggccgaaguaagaucauacugcuacgaagccuccaucuccgauauggcaagcgacucacguugccccacccaaggugaagccuacuuagacaaacaaagcgacacacaauacgucugcaaaaggacccucguagaucgcggauggggaaacggcugcggacuauucgguaaaggaucgcucgugacaugugccaaauucgccugcuccaagaaaaugacaggcaaauccauccaaccagaaaaccuagaauaccgcauaaugcucucaguacacggaucccaacacagcggcaugaucgucaacgacacaggccacgaaaccgacgagaacagagccaaaguagaaauaacacccaauagcccacgcgcagaagccacacucggcggauucggaucucucggccucgacugcgagccacggacaggacuugacuuuuccgaccucuacuaccugaccaugaacaacaaacacuggcuagugcacaaggaaugguuccaugacaucccucuccccuggcacgcaggagccgacacgggcacaccgcacuggaauaacaaagaagcccucguagaguucaaggacgcacacgccaaacgacaaacggucgucguccuaggaucacaagaaggcgcaguacacacagcgcucgccggagcccuagaggcggagauggacggggcaaaaggccgccucuccaguggacaccucaagugccgacucaaaauggauaagcuccgacucaaaggcguaucuuacucccuaugcaccgccgcauucacauucacgaaaauccccgccgaaacccuccacggcacggucaccgucgaaguacaauacgcaggcaccgauggcccaugcaaaguaccagcacaaauggcaguggacaugcaaacacucaccccagucggacgacucaucaccgcaaacccagucaucaccgaauccaccgaaaacucaaaaaugaugcuagaacucgacccacccuucggcgauaguuacaucgucauaggcgugggggaaaagaagauaacacaucacuggcaccgaucaggguccacgaucggcaaagccuucgaggccacaguacgcggagcaaagcgcauggcaguccuaggagauacagccugggauuucgggaguguaggcggcgcccuaaacagccuaggcaaaggcauacaccaaauauucggcgccgccuucaaaagccuauucggaggcaugagcugguucagccaaauacucauaggaacgcuccucauguggcuuggacuaaacacaaagaacggaagcauaagccucaugugccuagcacuaggaggcguacuaaucuuccugagcaccgcggucagcgca

SEQ ID NO: 11164 - RNA, 2073 nt, Artificial Sequence
  ZIKV (strain ZikaSPH2015) prME-short variant CDS opt
augaacgaagggucaaucauguggcuugcaucccuagcaguagugaucgccugcgcgggcgcggucacacgacggggcuccgccuacuacauguaccucgaccgcaacgacgcaggcgaagcaaucagcuuccccacaacgcuaggaaugaacaaaugcuauauacaaauaauggaccucggccacaugugcgacgcaaccaugagcuacgaaugcccaaugcuagacgaaggcguggaaccggacgacguggacugcuggugcaacaccacauccacaugggugguauacgguaccugccaccacaagaaaggcgaagcacgaaggucacggagagcagucacccuaccaucccacagcaccagaaaacuacaaacacgaucccagaccuggcuagaaagccgcgaauacacgaagcaucuaauaagggucgaaaacuggauauuccgaaaccccggauucgcacuagccgcagcggcaauagcauggcuacuagggucaagcacgucccaaaaaguaauuuacuuaguaaugauccuccuaauagcaccagccuacucaaucagaugcauaggcguaagcaaccgagacuucguagaaggcaugagcggcgggaccuggguagacauaguacucgaacacggaggcugcguaaccguaauggcacaagacaaaccaacaguagacaucgagcuaguaaccacaacaguaucgaacauggcggaaguacgcuccuacugcuacgaagccucgaucuccgacauggccagcgacucacgcugcccgacccaaggggaagcauaccuagacaaacaauccgacacgcaguauguaugcaaacgaacacugguugaccguggaugggggaauggaugcggacucuucggaaaaggcucgcucgucacaugcgccaaauucgccugcagcaagaaaaugaccggcaaaagcauucaaccagaaaaccucgaauaccgaaucaugcucagcguacacggcucacaacauagcgggaugauagucaacgacacaggacacgaaacggacgaaaaucgggcaaaagucgaaaucaccccaaacucaccacgcgcagaagccacacucggaggcuucggcagccuaggacuagacugcgaacccagaacgggacuagacuucagcgaccucuacuacuuaaccaugaacaacaaacacuggcugguccacaaagaaugguuccacgacauaccacucccauggcacgcaggcgccgacaccgggaccccacauuggaacaacaaagaagccuuaguagaguucaaagacgcgcacgcaaaaagacagacagugguaguacugggaagccaagaaggcgcaguccacacagcacuagccggagcgcuggaagccgaaauggacggcgccaaaggcagacuauccuccggacaccucaaaugccgccucaaaauggacaaacuacgccuaaaaggagucagcuacucacucugcacagccgcguucaccuucacuaaaauacccgcagaaacccuacacgggaccgucaccguagaaguacaauacgccggcacugacggaccaugcaagguaccagcccaaauggccgucgacaugcaaacccuaacucccguaggacgacucaucacggccaaccccguaauaaccgaaagcacagagaacucaaaaaugaugcucgaacuagacccacccuucggagacagcuacaucgucaucggcguaggcgagaaaaagauuacccaccacuggcacaggagcggcagcacgaucggaaaagccuucgaagccacagucagaggggccaaacgcauggccguacugggcgacacagccugggacuucggcaguguaggaggggcccucaacagccucggaaaaggcauccaccaaauuuucggagccgcuuuuaaaagucuauucggaggaauguccugguucucacaaauacucauuggcacacuccuaauguggcucggccuaaacaccaagaacggcagcaucagccuaaugugccuagcccucggcgggguacuaauauuccugagcacagccgucuccgcc

SEQ ID NO: 11165 - RNA, 2073 nt, Artificial Sequence
  ZIKV (isolate Z1106033) prME-short variant CDS opt
augaacgaaggcucgaucauguggcucgccucccuagcagucgucaucgcaugcgcaggagcagucacccgccggggauccgcguauuacauguaccucgaccggaacgaugcaggagaagcaaucagcuucccgaccacacucgggaugaacaaaugcuacauacaaauaauggaccucggacauaccugcgacgcaaccauguccuaugaaugcccgaugcuugacgaaggagucgaaccagacgacguagacugcuggugcaacaccacaagcacaugggugguauacggcacaugccaccacaagaaaggagaagcgcgcaggaguagacgcgccgucacccucccaagccacucaacacgcaaacuccaaacacgaucacaaaccuggcucgaaagccgagaauacaccaagcaccuaauccgcgucgagaacuggaucuuccgcaacccaggauucgcgcucgccgcagcagccaucgccuggcuccuaggguccagcaccagccaaaaggugaucuaccuagucaugauacuccucaucgcaccagcauacucgauccgcugcauaggcguaucaaauagagacuucguagagggaauguccggcggaaccugggucgacguaguccuagaacacggcggcugugucaccgugauggcacaagacaaaccaacaguagacauagaacuuguaacaacgacaguaaguaacauggcggaaguccgcagcuacugcuacgaagcauccauaucagacauggccagcgacagccgcugccccacgcaaggcgaggcauaccuagauaagcaaucagacacccaauaugucugcaaaagaacccuaguggaccgcggcuggggcaacggaugcggccucuucgggaaaggcucccucgucacgugcgccaaauucgccugcucaaagaaaaugaccggaaaaagcauacaacccgaaaaccuagaauaccgaaucaugcucucgguacacggaucacaacacagcggaaugaucguaaaugacaccggacaugagacagacgaaaacagggccaaagucgaaaucaccccaaauaguccccgcgcagaagccacccucgguggguucggcagucucggacuagacugugaaccacgaaccggccucgacuucagcgaccuauacuaccuaacaaugaacaacaaacacuggcucguccacaaagaaugguuccacgauaucccgcuacccuggcacgccggagccgacaccgggacaccacacuggaacaacaaagaagcccucgucgaguucaaagacgcgcacgcuaaacgccaaaccguagugguccucggaucccaggaaggagccguacacaccgcacuagcaggagcccucgaggccgaaauggacggcgcaaaaggaagacucucaagcggccaccucaagugcagacucaaaauggacaaacuaagacugaaaggaguauccuacucccucugcacggccgccuucacauucacuaaaaucccagccgaaacgcuccacggaacaguaacaguggaagugcaauacgcgggaacugacggaccaugcaaaguacccgcccaaauggccgucgacaugcaaacacuaacaccagucgggcgacuaaucacagccaauccaguaauaacggaaucaaccgaaaacaguaaaaugaugcuagaacuagacccacccuucggagacagcuauauaguaaucggagucggagaaaagaaaauaacccaccacuggcacagaagcgggagcaccaucgggaaagccuucgaggcaacggugagaggcgcaaaacgaauggccguccucggagacaccgcaugggacuucggauccgugggcggagcccugaacucacuaggaaaaggcauccaucaaauauucggggccgccuucaaaucccucuucggcgggaugucgugguucucacagauacucaucgggacacuacucauguggcucgggcucaacgccaaaaacggaagcaucucacucaugugccuagcacuagggggaguccuaaucuuccuguccacagcaguaagcgcu

SEQ ID NO: 11166 - RNA, 2061 nt, Artificial Sequence
  ZIKV (strain MR 766) prME-short variant CDS opt
augaacgagggcucaaucauguggcuggccucacuagccguagugauagcaugcgcaggcgcaaucacacgccgggguucagcauacuacauguacuuagacagaagugacgcaggaaaagcaaucucauucgccacaacccuaggagucaacaaaugccacguacaaauaauggaccuaggccacaugugcgacgcaacgauguccuacgaaugccccauguuggacgaaggcguagagcccgacgaugucgacugcuggugcaacaccacgaguaccuggguagucuacggcacgugccaucacaagaaaggagaagccagaaggucgaggagagcagucacacugccgagccacagcacacgaaaacuccagacacgaucccagaccuggcucgaaagcagggaguacacaaaacaccucauaaaagucgaaaacuggaucuucaggaacccaggauucgcgcuaguagcaguagccaucgccuggcugcuagguagcagcacgucccaaaaagucauauaccucguaaugauccuauuaauagcaccagcauacucgauaagaugcauaggaguaaguaaccgagacuucguagaaggaaugucaggcggcacauggguagacguaguacuagaacacgguggaugcguaaccgugauggcacaagacaaacccacaguagacauagagcuaguaaccacgacuguaagcaacauggcugaaguccgaagcuacugcuacgaggcaucgaucuccgacauggccuccgacagccgcugcccaacacaaggagaagccuaccuagauaaacaaucggacacgcaauacgucugcaaacgcacucuagucgaccgcggauggggaaacggcugcggacuguucggaaaaggcagccuaguaacaugcgccaaauuuaccugcucaaagaaaaugaccggcaaaucaauacagccagaaaaucucgaauacagaaucaugcuaucaguacacggcucgcaacacagcgggaugaucggguacgaaacagaugaagaccgagcaaaaguagaagucacaccgaacagcccaagagcagaagccacacuuggaggguucggaucacuaggcuuggacugcgagccacgcacaggucuagacuucagcgaccuguacuacuugaccaugaacaacaaacauuggcuaguacacaaagagugguuucacgacauaccccuccccuggcacgccggcgccgacaccggcaccccacauuggaacaacaaagaagcgcuggucgaauuuaaagacgcgcacgcaaaacgacagacggucguaguacucgggagucaagaaggcgccguccacacagcccucgcaggggcgcuagaagcagaaauggacggggcgaaagggaggcuauucaguggccaccuaaaaugccggcucaaaauggacaaacuacgauugaaaggagucucauacucacuaugcaccgcggcguucacauucacaaaagucccggccgagacacugcacggaaccguaaccgucgaaguacaguacgcaggaaccgauggccccugcaagaucccgguacaaauggcggucgacaugcaaacccucacccccguaggacgacuaauaaccgcaaaccccgucauaacagaauccacagaaaacagcaaaaugaugcuagaacucgacccgcccuucggugacuccuacaucguaaucggugucggcgacaagaaaaucacacaucacuggcaccgaagcggcagcacaaucggaaaagcauucgaagccacagugcgcggcgcaaaacgaauggcaguacugggcgacaccgcuugggacuucggcagcgucgggggcguauucaacagucuaggcaaaggcauucaccagaucuucggagcagcguucaagagccuauuuggaggcauguccugguucagccagauucuaauaggcacacuucuagucuggcuaggacuaaacaccaaaaacggaagcaucagccuaaccugccucgcgcucggaggcguaaugauauuccuaagcacugccguaagcgca

SEQ ID NO: 11167 - RNA, 2073 nt, Artificial Sequence
  ZIKV (strain NatalRGN) prME-short variant CDS opt
augaacgagggaagcauaauguggcucgcaucauuagcagucguaaucgccugcgccggagccgugacgagacgcggcuccgccuauuacauguaccuagaucgaaacgacgcaggcgaagccauaucauucccaacgacacuaggaaugaacaagugcuacauacaaauaauggaccuaggccacaugugcgacgcaaccaugagcuacgaaugcccaaugcucgacgaaggcgucgaacccgacgacguagacugcuggugcaacacuacauccacauggguagucuacggaacgugccaccacaaaaagggcgaagcaagacgaagcagacgcgccgucacacucccaagucacagcacccgaaaacuccaaaccagaagccagacauggcuagaauccagggaguacaccaaacaccuaauaagagucgaaaacuggaucuuccggaacccaggauuugcccuagcugcggcggcgauagcauggcuacucggcucaucaacaagccagaaagucaucuaccucguaaugauccugcucauagcaccagcguacucaauaagaugcauaggcgucagcaacagggacuucguugaaggcaugucaggcggcaccuggguggacguaguccucgagcacggaggcugcgucacaguuauggcacaggacaaacccaccgucgacaucgaacucgucacaaccacagucagcaacauggccgaaguccgcagcuacuguuacgaggcaagcaucagcgacauggccucggacuccaggugcccaacacaaggagaggcauaucuggacaagcagagcgacacacaguacgucugcaaacgaacgcuaguggaccgcggauggggaaacggcugcggacuuuucggcaagggaagccuaguaacuugcgcaaaguuugccugcucaaagaaaaugaccggaaaaagcauccaaccggaaaaccuagaauacagaaucaugcugagcguccacggaucccaacacagugggaugauaguaaacgacacaggacacgaaacagacgaaaaccgagccaaagucgaaaucacacccaacagcccgcgagcagaagcaacacucgggggcuucggaucacuaggacuagacugcgaaccacgcacagggcuagacuucagugaccuguacuaccuaacgaugaacaacaagcacuggcucguucauaaagaaugguuccacgacaucccccuaccguggcacgcaggggcagacacaggaacaccccacuggaacaacaaagaagcccucguggaguucaaagacgcacacgccaaacggcaaaccguaguaguccuuggaagccaggaaggagccguccacaccgcgcucgccggcgcccuagaagccgaaauggacggcgcaaagggacgacucagcagcggacaccuaaagugccgccuaaaaauggauaaacuccgccucaaaggcguaagcuacagccuaugcaccgccgccuucacauuuaccaaaauaccagccgaaacacuccacggcaccguaacagucgaaguacaauacgccgggacggacggaccaugcaagguccccgcccagauggcagucgacaugcagacccucaccccaguagggagacuaaucacagccaacccugucauaacggaauccaccgaaaacagcaaaaugaugcuagagcuagacccgcccuucggagacuccuacaucguaauaggcgucggcgaaaagaaaauaacacaucacuggcaccgaagcggcuccaccaucgggaaagccuucgaggccacaguaagaggagcaaaacgcauggcagugcuaggcgauacagcaugggacuucggcagcguaggcggggcgcugaacucccuaggaaaaggaauacaccaaauauucggagcagccuucaagucacucuucggcggaaugagcugguucucacaaauccuaaucggcacacuccuuauguggcucggccucaacaccaaaaacgggagcauaagccucaugugccuagcacuagggggcguccuaauauuucugagcaccgcggucagcgca

SEQ ID NO: 11168 - RNA, 2100 nt, Artificial Sequence
  ZIKV (strain ZikaSPH2015) prME-short variant CDS opt
augggacggaagcaaaacaagagaggcggcaacgaaggcaguauaauguggcucgcaagccuagcgguaguaaucgcaugugcuggagccgucaccagacgaggguccgcauacuacauguaccuagacagaaacgacgcaggagaggcaaucuccuuccccacaacacuaggcaugaauaaaugcuacauacaaauaauggaucugggacacaugugugacgccacgauguccuacgaaugcccaaugcuagacgaaggagucgaaccagacgacguagacugcuggugcaacacaacgagcacaugggucguauacgggaccugccaccacaagaagggagaagcccgccggagcaggcgcgccgugacacuaccaagucauagcacacgcaaacuccaaacccgaucacaaaccuggcuagaaagccgugaauacaccaaacaccucauccgaguggagaauuggaucuuucgaaacccaggauucgcccuagccgcagccgcgauagcauggcuauugggcagcuccaccucccaaaaagugauauaccuagucaugauacuacuaaucgccccagcauacucgauucgguguaucggggugagcaaccgcgacuucguagaaggcaugagcggcgggacaugggucgacaucguacuagaacacggcgggugcguaaccguaauggcccaagacaaacccacagucgacauagaauuaguaacgaccaccgucagcaacauggcagaaguaaggucauacugcuacgaagccucuaucuccgacauggccagcgacagcagaugccccacccaaggagaggcauaccuagacaaacagagcgacacgcaauacgucugcaaaagaacacucguagaccgcggauggggcaacggaugcggacuguucggcaaaggcucccugguaaccugcgccaaauucgcaugcagcaagaaaaugacaggaaaaagcauacaacccgaaaaccuugaguacagaauaaugcucagcguccacggaagccaacacagcggcaugauagucaacgacacaggacacgaaaccgacgaaaaccgagcaaaagucgaaaucaccccgaacucaccacgugccgaagcaacacugggaggcuucggaucacuaggcuuagacugcgaaccacgcacaggacuugacuucuccgaucuguacuaccucaccaugaacaacaaacacuggcuagugcacaaagagugguuccacgacaucccccuccccuggcacgcgggagcagacaccggcacaccccacuggaacaacaaagaagcacugguugaguucaaggacgcacacgccaaacgccaaaccguaguggugcucggcucccaggaaggagccguacacacggcacucgccggugcacuagaagcagaaauggacggagccaaaggccgcuuaagcucuggccaccuaaaguguagacugaagauggacaaacuccgccucaaaggagucagcuacucacucugcacagcagccuucaccuucaccaaaauccccgcagaaacacuacacgggacagucaccguugaaguacaauacgcaggcaccgacggacccugcaaaguccccgcacaaauggcaguagacaugcaaacccucacaccagucggccggcuaauaaccgccaaccccgugauaacagaaagcaccgaaaacagcaaaaugaugcuagaacucgacccgccauucggggacucauacaucguaaucggcguaggagaaaagaaaauuacacaccacuggcaccguucaggcaguacccuaggcaaagcauucucaacaacccuaaaaggcgcacaacgacuagccgcccugggugacacagcaugggacuucggaagcauagguggaguauucaacagcaucggacgggccguccaucaaguguucggcggcgcauucagaacccuguucggcggcaugucuuggaucacacaaggacuaaugggggcccuccuauuauggaugggcguaaacgcaagagacagaaguauagcccuggcauuccuugccacaggcggaguacugguauuccuggccaccaacguccacgcg

SEQ ID NO: 11169 - RNA, 2100 nt, Artificial Sequence
  ZIKV (isolate Z1106033) prME-short variant CDS opt
augggcagaaaacaaaacaaaaggggagggaacgagggcagcauuauguggcuggccagccucgccgucguaaucgcgugcgccggugcaguaacacgcaggggaagcgcauacuacauguaccuagaccgaaacgacgcaggagaagcaauuagcuucccuacaacgcuaggaaugaacaaaugcuacauccaaauaauggaccuaggucacaccugugacgcaaccaugagcuacgagugucccaugcucgacgaaggcguagagcccgacgacgucgacugcuggugcaacacaaccuccacauggguaguauauggcacaugucaccacaagaaaggagaggcacgcagguccagacgcgcgguaacccuaccaagccacagcacuagaaaacugcaaacaagaucccaaaccuggcuagagagcagagaauacacaaaacaccucauccgaguagaaaacuggauauuccgaaaccccggcuucgcgcuagcugccgcagccauagccuggcuacucggaucgagcacaagccagaaaguaaucuaccugguaaugauacuucuaaucgcaccggcguacuccaucaggugcauaggaguaagcaaccgagacuucgucgaaggaaugagcggaggaacauggguagacgucgugcucgaacacggcggcugcguaacaguaauggcacaagacaaacccacaguagacaucgagcuagucacaacaacuguaagcaacauggcagaaguacgcagcuacugcuaugaagccucaauaucagacauggcaagugauucccgaugcccaacacaaggcgaagcguaccuggacaaacaaucggacacacaguacguaugcaaacgcacccuggucgaccgaggcugggggaacggauguggacuauuuggcaagggcagccucgucaccugugccaaguucgcgugcagcaaaaagaugacaggcaaguccauacaaccagaaaaccucgaguaccgaauaaugcuauccguacacggcucccaacacuccggcaugaucguaaacgacaccggacacgaaacugacgaaaaccgcgcaaaaguugaaauuacaccaaacucgccacgugccgaagcaacucuaggcggguucggaucccuaggccuggacugcgagccaagaacaggacucgacuucagugacuuauacuaccuaacaaugaacaacaaacacuggcuaguccacaaagagugguuccaugacauaccccucccauggcacgcaggggccgacacuggaaccccacacuggaacaacaaggaagcccuagucgaguuuaaagacgcacacgcgaagcggcaaaccguaguaguccucggaucccaagaaggagcgguucauacagcacucgcgggagcccuggaagccgagauggacggagccaaaggccgccugagcucaggacaccuaaaaugccgccucaaaauggacaagcuccgacugaaaggaguaucauacucccugugcaccgccgccuucaccuucacaaagaucccagcagagacccuccacggcacagugaccguagaaguacaauacgcaggaaccgacggaccaugcaaaguacccgcccagauggcagucgacaugcaaacgcuuacaccggucggacgccugauaacagccaacccaguaaucacagaaucaaccgaaaacucuaaaaugaugcuagaacucgauccacccuucggcgacagcuacaucgucaucggagucggagaaaagaaaauaacccaccacuggcaccgauccggauccacauuagggaaagcauucagcacuacacucaaaggcgcccaacgacucgcagcauuaggagacaccgcgugggacuucggcagcauaggaggagucuucaacucaaucgggcgggcaguccaccaaguguucgggggcgcauucaggacacuauucggcggcaugaguuggaucacacaaggacucaugggagcgcuccuccucuggaugggagucaacgcuagagaccgcagcauagcccucgcauuccucgcuaccggcggcgugcucguguuccuagccacgaacguacacgcc

SEQ ID NO: 11170 - RNA, 2088 nt, Artificial Sequence
  ZIKV (strain MR 766) prME-short variant CDS opt
augggcagaaaacaaaacaaacgcgggggcaacgagggcucgauuauguggcucgcaucacucgcagucgugauagcgugcgcaggagcgauaacgaggagaggaagcgccuacuacauguaccuggacagaagcgacgcagguaaagcaaucucguucgcaacaacacuagggguaaacaaaugccacguccaaauuauggaccuaggccacaugugcgaugcgacgauguccuacgagugcccgaugcuagacgaaggcguggaaccagacgacguagacugcuggugcaacacaacgagcacauggguggucuacggaacaugccaucacaagaaaggcgaagcccgcaggagcaggcgagcggucacucucccaagccacagcacgcggaaacuacaaacaagaagccagacauggcuugaaagccgcgaauacacaaaacaccugaucaaagucgagaacuggauauuccgaaaccccggguucgcacucguagcaguagcaauagcauggcuacuaggcucgaguaccagccagaaaguaauauaccucgugaugauacuacugaucgcgcccgccuacagcauccgcugcauaggcgucagcaacagagauuucguagaaggaaugucaggaggaacaugggucgacgucguacuagagcacggaggcugcguaacgguuauggcccaggacaaaccaacggucgacaucgaacucgugacaacaacagucagcaacauggcggaagugcgaucauacuguuacgaagcaagcauaucagacauggcaucagacucaagaugcccuacucaaggagaggcuuaccuagacaaacaaagcgacacccaguacgucuguaaaagaacauuagucgaccgaggauggggaaacgggugcggacucuucggaaaaggcucacucguaacgugcgccaaauucacaugcuccaaaaagaugacgggaaagagcauacagccagaaaaucuagaguacagaaucaugcugucaguacauggcucgcagcacagcggaaugauaggcuacgaaacggaugaagacagagccaaagucgaagucacgcccaacagcccgagagcagaagcgacccuaggcggguucggaagccugggccuagacugcgaaccgcguacgggacuggacuuuagcgaccuauacuaccucacaaugaacaauaaacacuggcuaguccauaaagaaugguuccacgacaucccgcuaccauggcaugccggggcagacacaggaacaccccacuggaacaauaaagaggcccuaguagaguucaaagacgcgcacgcaaaacgccagaccgucgugguccugggaucacaagaaggagcgguccacacagcucucgcaggagcacucgaagcagaaauggacggcgcgaaaggccgacucuucagcggccaccuuaagugcaggcucaaaauggacaaacuacgacugaaaggggucucauacagccucugcacagcagccuuuacguucacaaaaguaccagccgaaacacugcacgggaccgugacaguggaagugcaauacgccgguacagacggacccugcaaaaucccaguccaaauggcgguggauaugcaaacccuaacuccggucggccgacuaauaacggcaaauccagugaucacagaaucaaccgaaaacucaaaaaugaugcuagaacuagacccgccauucggcgacagcuacauaguaaucggggucggggacaagaaaauaacgcaucacuggcacagaagcgggagcacacucggcaaggcuuucagcacaacacuaaaaggcgcgcaaagacuugcagcacucggcgauaccgcgugggacuucgggaguauaggaggagucuucaacucaauaggacgcgcaguccaccaaguauucggaggagcauucagaacccucuucggcggcauguccuggauaacccaagggcucaugggugcgcugcuucucuggaugggggucaacgcccgggacagaagcaucgcacuagccuuucuagcaacaggaggaguacuuguauuccucgccacaaacgugcacgca

SEQ ID NO: 11171 - RNA, 2100 nt, Artificial Sequence
  ZIKV (strain NatalRGN) prME-short variant CDS opt
augggacgcaaacagaacaagagaggaggaaacgaaggcagcaucauguggcuagcaucgcuagcaguaguaaucgccugcgccggcgccgucacaagacgaggcucggcauacuacauguaccuagaccgcaacgacgccggugaagcuaucucguuccccaccacgcuaggcaugaacaaaugcuacauacaaauaauggaucucgggcacaugugcgacgccacaaugucguacgaaugccccaugcuagacgaaggagucgagccugacgauguugacugcuggugcaauaccacaagcaccugggucguauacgguaccugccaccacaagaaaggcgaagcacgcagaagccgccgggcggucacccugccgagccacagcacgcgaaaacuacaaacaagaagucagaccuggcuagaauccagggaauauaccaaacaccucaucagagucgaaaacuggaucuuccgcaaccccggauucgcgcuugcagcagcagcaauagcauggcuacucgggucaagcacgagccaaaaagucaucuaccucguaaugauacuacucaucgcaccagccuacagcauaagaugcauaggagucagcaacagagacuucguagaaggcaugaguggcggcacaugggucgacgucguacuggaacacgggggcugcgucaccguaauggcacaagacaaaccaaccgucgacaucgaacucguaacaacgacagugagcaacauggcagaaguaagaucauacugcuacgaagccucaauauccgacauggccagcgacucaagaugccccacacaaggagaagcauaccuagacaaacaaucggacacccaauaugucugcaaaaggacccuagucgacagaggauggggcaacggcugcggccucuucggcaaaggaucacucguaaccugcgcaaaauucgcaugcucaaagaaaaugacgggcaaaagcauccagcccgaaaaccucgaauacagaaucaugcucagcguacacggcagccaacacagcggaaugauagugaacgacacaggacacgagaccgacgaaaaccgcgcaaaagucgagaucacaccaaacagcccacgagccgaagccacacuaggaggcuucggaagccuaggauuagacugugaaccccguaccggccuggacuucagcgaccucuauuaccucacgaugaauaacaaacacuggcugguacacaaagagugguuccaugacauaccacugccuuggcacgccggagccgacaccggcacaccccacuggaacaacaaagaggcccugguggaguucaaagacgcgcacgccaaacgacaaacagucguggucuugggaucacaagaaggcgccguacauacagcacuagcgggagcccuagaagccgaaauggacggcgcaaaaggacgccuaagcaguggacaccuuaaaugccggcuaaaaauggacaaacuaagacugaaaggaguaagcuacucacuauguacagcagcauucacauuuacaaagaucccagccgaaacacugcacggaacuguaacagucgaaguccaauacgcaggcacagacggaccauguaaaguacccgcccaaauggcaguggauaugcagacccuaacccccguagggcgauuaaucaccgcuaaccccguaauaaccgaguccacagaaaacagcaaaaugauguuagaacucgacccacccuucggagacagcuacaucgucauaggagucggagaaaagaaaauaacacaccacuggcaccggagcggaagcacacucggaaaagcauucucaaccacgcuaaaaggcgcgcaacgacuagcggcgcucggcgacaccgccugggacuucgggagcauaggcggagucuucaacagcaucgggcgagccgugcaccaggucuucggaggagcauuccggacccuuuucggaggcaugucauggaucacacaaggccuaaugggagcacuccuccucuggaugggaguuaacgcaagagaccggagcauugcccucgcguuucuagccacagggggcguccuaguauuccuagccacaaacguacaugca

SEQ ID NO: 11172 - RNA, 2073 nt, Artificial Sequence
  ZIKV (strain ZikaSPH2015) prME-short variant CDS opt
augaacgaaggcucuauaauguggcuugcaucgcucgccguuguaauagcaugcgcaggcgccguaaccagacgcggaagcgcguacuacauguaccuggaccgaaacgacgccggagaagccaucuccuuccccacaacacucggcaugaacaaaugcuacauacaaauaauggaccucggacacaugugcgacgccacgaugucauacgagugccccaugcucgacgaaggagucgaaccagacgacgucgacugcuggugcaacaccaccucgaccugggucgucuacggaaccugccaccacaagaaaggagaagcccgacgaagucgcagagccguaacacuccccucccacagcacacgaaaacuccaaacaaggucacaaaccuggcucgaaucccgugaauacaccaaacaccuaauccgagucgaaaacuggaucuucagaaaccccggauucgcacuagcagcagccgcaaucgcguggcuccucggcucauccaccucccagaaagucauauaccucgucaugauacuacuaauugcaccggcguacuccauacgcugcauaggcguaagcaaccgggacuucgucgaaggaauguccggaggcacguggguggauauaguccucgagcacggaggcugcgucacagugauggcacaagacaaaccaaccgucgacauagaacucgucacaaccacaguuagcaacauggcggaaguccgaagcuacugcuacgaagcaagcauaucggacauggcgucagacucacggugcccgacacaaggggaagccuauuuagacaaacaauccgacacgcaguacgucugcaaaagaacgcuagucgacagaggauggggcaacggauguggccucuucggaaaaggcagccuaguuacaugcgcaaaauucgcaugcucaaagaaaaugacaggaaaauccauacaacccgaaaaccucgaauaccggauaaugcucucaguacacggcucacaacacagcgggaugauaguaaacgacacaggacacgaaacagacgagaacagagcuaaagucgaaaucacaccaaacucgccacgcgcagaagcgacccuuggaggauucggcagccuaggccucgacugugaacccagaacaggccuagacuuuuccgaccucuacuaccucacuaugaacaauaaacacuggcuaguccacaaagaaugguuccacgacauaccccuacccuggcacgccggggccgacacaggaacaccccacuggaacaacaaagaagcacucguggaguucaaagaugcacacgccaaaagacaaacggucgucguacugggaucacaagaaggagcagugcacacagcgcuagcaggagcacuggaagccgaaauggacggcgcaaaaggccgccuaagcuccggacaccucaaaugccgacuaaagauggacaaacuacgacucaaaggaguauccuacucacuaugcacagcggcguucacauucaccaagauucccgccgaaacccuacacggaaccgugaccguagagguccaauacgcuggcaccgacggaccgugcaaaguaccagcacaaauggccguagacaugcaaacgcucacacccgucggccgccuaaucaccgcaaaccccguaauuaccgaaucaacagaaaacuccaaaaugaugcucgaacuagauccacccuucggagacuccuacaucguaaucggugucggugaaaagaaaaucacccaccacuggcacaggucaggauccacccucgggaaagcauucagcaccacacuaaaaggcgcucaacgccuagccgcccuuggugacacugcuugggacuucggcaguauaggcggcgucuucaacagcaucggacgcgccguccaucaaguauucgggggcgcauucaggacccuauucggaggaauguccuggaucacgcaaggccucaugggggcccuccuccuauggaugggagucaacgcccgcgaccgaagcaucgcccucgccuuccucgcaaccggaggcgugcucguguuccuggccacaaacguacacgca

SEQ ID NO: 11173 - RNA, 2073 nt, Artificial Sequence
  ZIKV (isolate Z1106033) prME-short variant CDS opt
augaacgaaggcagcauaaugugguuagcaucccuagccguagugauagccugcgccggcgccgucacacgaagaggaucagccuacuacauguaccuugacagaaacgacgcaggagaagcaaucucauuccccaccacccucgggaugaacaaaugcuacauacaaaucauggaccuaggccauaccugcgacgcuaccaugagcuacgaaugccccaugcucgacgaaggcgucgaacccgacgacgucgacugcuggugcaacaccaccuccacuugggucguauacggaaccugccaccacaagaaaggcgaagcacgccgaucccgccgagcugucacacuacccagccacagcacgcgcaaacuccaaacacgaagccaaaccuggcuggaaucccgggaauacacaaaacaccugauccgagucgagaacuggauauuccguaaccccggcuucgcccuugccgcagccgccaucgccuggcuccuagggagcuccacgagccaaaaagucauauaccucgucaugauccuccuaaucgcacccgccuacagcauaagaugcauaggcgucucaaaccgagacuucguagaaggcaugucaggcggcaccugggucgacgucguccuagaacacggagguugcguaacggucauggcacaagacaaaccaaccgucgacauagaacucgucaccaccacaguaagcaacauggccgaaguacgauccuacugcuacgaagcauccauauccgacauggcaagcgacucacgcugccccacacaaggggaagcauaccuugacaaacaguccgacacccaguauguaugcaaacggacccuaguagaccguggcuggggaaacggcugcggccucuucggcaaaggaucacucgucacaugcgcaaaauuugcgugcuccaagaaaaugacaggcaaaaguauacagccugaaaaccuagaauaccgcauaaugcuaagcguccacggcagccaacacuccggcaugauuguaaacgacaccggccacgagacagacgaaaaccgcgccaaagucgaaauuacccccaauucaccaagagcagaagcaacccuaggcggcuucgggagccucggacuagacugcgaaccacggaccggucucgacuuuagcgaccuauacuaccugacuaugaacaacaaacacuggcucguacacaaagaaugguuccacgacauaccccucccauggcacgccggcgccgauaccggcacaccccacuggaacaacaaagaagcgcuaguugaguucaaagacgcacacgcaaaacgacaaaccguaguaguccucggcucgcaagaaggggccguccauaccgcccucgcuggagcccucgaagccgaaauggacggagcaaaaggccgccucagcuccggccaccucaaaugcaggcucaaaauggacaaauuaagacucaaaggcgugucauacagccuaugcaccgccgccuucaccuucacaaaaauaccggcagaaacccuacacggcacagucacaguagaaguccaguacgcaggaacagacggccccuguaaagucccagcgcaaauggcaguugacaugcaaacccucacccccgucggcagacucaucacagcgaacccagucaucacagaaucaacagaaaacaguaaaaugaugcuagaacuugacccacccuucggggacagcuacauagucaucggcguaggggaaaagaaaauaacacaccacuggcaccgcucagguagcacacuaggcaaagccuucucaacaacccuaaaaggcgcacaacgcuuagccgcccuuggcgacaccgccugggacuucgguagcaucgguggaguauucaacuccaucgggcgagcgguacaccaggucuucggaggugcguuccggacccuauucgggggcaugucauggaucacccaagggcuaaugggagcucuccuccuauggaugggcguaaacgcacgagaccgguccauagcacucgccuuccuagcaaccgguggcguucuaguguuccuagccaccaacguacacgca

SEQ ID NO: 11174 - RNA, 2061 nt, Artificial Sequence
  ZIKV (strain MR 766) prME-short variant CDS opt
augaacgaaggaucaaucauguggcuagccucccuagccgucguaaucgcaugcgcaggagcaauaacuagacggggaucagcauacuacauguaccucgaccgcagcgacgccgggaaagcaauauccuucgcaaccacacucggagucaacaaaugccacguccagauaauggaccucggacacaugugcgacgccacaaugucguacgaaugccccaugcuagacgaaggaguagaacccgacgacgucgacugcuggugcaacaccacaagcacauggguggucuacggcacuugucaccacaagaaaggcgaagcacgacggagccgcagagccgucacccucccaagccacagcaccagaaaacuacaaacccgcagucaaacauggcuagaaaguagggaauacacaaagcaccugaucaaaguagaaaacuggauuuuccgcaaccccggcuucgcgcucguagccgucgcgauugcauggcuccuaggcuccucaaccucccaaaaaguaauauaccuaguaaugauucuccucaucgcccccgccuacuccauccgcugcauaggcguaagcaaccgcgacuucguagagggaaugaguggcggaaccugggucgaugucguacuagaacacggaggaugcguaacaguaauggcccaagacaaacccacgguagauauagaacucguaacuaccaccguauccaacauggcagagguccgcucuuacugcuacgaagccuccaucucagacauggcaagcgacagccgcugccccacccaaggcgaagcguaccucgauaagcaauccgacacccaauacgucugcaagagaacccucguagacaggggaugggguaacggaugcggacuauucggaaagggcagccuaguaaccugcgcaaaauucacaugcuccaaaaagaugaccggcaaaucaauccaacccgaaaaucucgaauacagaauaaugcuaucaguccacggaucgcaacacuccgggaugauuggcuacgaaacagacgaagaccgggccaaggucgaaguuacgccuaacagcccccgcgcggaagcaacccuaggcggguucggaagucuaggccuggacugcgaaccgcgaaccggccucgacuucagcgaccuguauuaccucacaaugaauaacaaacacuggcucguccauaaagagugguuccacgacaucccccucccauggcacgcaggggccgacaccggcaccccacacuggaacaacaaagaagcccucguagaguucaaagacgcccacgccaaaaggcagacugucgucguacuaggcagccaagaaggcgcaguccacaccgcccuagcaggcgcacuggaagcagaaauggauggagcaaaaggacgccucuucaguggacaccucaagugccgacuaaagauggacaaacuucgacuaaaaggcgucucguacucacucugcaccgcagccuucaccuucacaaaaguaccggcagaaacacugcacgggacaguaaccgucgaaguccaauacgccggaacagacggcccaugcaagauucccguacaaauggcagucgacaugcagacccugacccccgucgggcgccuaaucacagcaaacccagugaucacagaaucaaccgaaaacuccaaaaugaugcuagaacuugaucccccauucggcgacuccuacaucgucauaggcguaggcgacaagaaaaucacccaccacuggcacagaagcggaagcacacucggcaaggcauuuucaaccacucuaaagggagcccaacgccuagcagcccuaggagacaccgcaugggacuucggaagcaucgguggcguuuuuaauucaauuggacgcgcaguucaccaggucuucggaggcgcauuccgaacacuauuuggaggaaugagcuggaucacccaagggcucaugggcgcgcuccuacuauggaugggagucaacgcacgcgacagauccauagcccucgccuuccucgcaacagggggagugcucguauuccucgcaaccaacgugcacgcg

SEQ ID NO: 11175 - RNA, 2073 nt, Artificial Sequence
  ZIKV (strain NatalRGN) prME-short variant CDS opt
augaacgaaggauccaucauguggcucgcgucacuagccguaguaaucgcgugugccggagccguaacccgaagaggcucggcauacuacauguaccucgaccgaaacgacgcgggugaagcaaucuccuuccccaccacacucgggaugaacaagugcuacauacaaauaauggaccucggacacaugugcgacgcaacaauguccuacgaaugcccaaugcuggacgaaggcguggaaccagacgacgucgacugcuggugcaacacaacaagcacaugggugguuuacgggaccugccaccacaagaaaggcgaagcacgccgaucccgcagagcagucacacucccgagccacagcacacgcaaacuacaaaccagaagccagacaugguuagaaagccgagaauacacaaaacaucuuauccgaguagaaaacuggaucuuccgcaaucccggguucgcacucgccgccgcagccaucgcauggcuccugggcucaagcacaucccaaaaaguaaucuaucuagugaugauccuccugauagcccccgccuacucaauacgcugcauaggaguuagcaaccgcgacuucguggaaggaauguccggcggcacaugggucgacgucguccuagaacacggcggauguguaaccgucauggcgcaagacaaacccacggucgacauugagcuaguuacgacaacaguaagcaauauggcagaaguccgauccuacugcuacgaagccucaauaagcgacauggccucagacucgcgcugccccacccaaggagaagccuaccucgacaaacaaucugacacccaauacgucugcaaacgaacccuagucgacagaggguggggaaacggaugcggccuuuucggaaaaggcagccucgugaccugcgccaaauucgcgugcucgaagaaaaugaccggcaaaagcauacaaccagaaaaccuagaauauagaaucaugcucuccguccauggcucacaacacagcggcaugauaguaaacgacacaggccacgaaaccgacgaaaaccgagccaaaguagaaauaacacccaauucccccagagcagaagcuacacuagguggcuucgggucccugggacucgacugcgaaccacgaaccggacuagacuucagcgaccucuauuaccuaaccaugaacaacaaacacuggcuaguccacaaagaaugguuucacgacauaccgcuaccauggcacgccggagcugacacagggacaccacacuggaacaacaaagaggcccugguagaguucaaagacgcgcacgcgaaacggcaaacagucguaguccugggcucccaggaaggcgcgguccacaccgcucucgccggcgcccuagaagccgaaauggacggcgccaaaggaagacugagcagcgggcaccugaaaugcagacucaaaauggacaaacugcgccuaaaaggagucuccuacagccucugcacagccgcauucaccuucacaaaaauccccgcagaaacccuacacgggacaguaaccguugaaguacaauacgcagggaccgacggaccaugcaagguaccggcacagauggcagucgacaugcaaacacuaaccccagucggccgccuaauaaccgcaaacccaguaauaacagaauccacagagaacucaaaaaugauguuagaacucgaucccccauucggcgacagcuacauagucauuggcgucggagagaaaaagauaacccaccacuggcacagaagcggauccacccuaggcaaggcauucucaaccacccuaaaaggcgcccaaagacuugcagcacucggcgacacagcgugggacuucggaagcauaggaggagucuucaacucaauagggagagcgguccaccaagucuucggcggagcguucagaacccuauucggcggcaugucauggauaacgcaaggacuaaugggcgcccuacuacuauggaugggcgucaacgccagggacaggagcauagcacuggcauuccuagccaccggcgggguccucguguuccuggccaccaacgugcacgca

SEQ ID NO: 11176 - RNA, 2100 nt, Artificial Sequence
  ZIKV (strain ZikaSPH2015) ME variant CDS opt
augggcagaaaacaaaacaaacgcggcggcaacgagggcucgauaauguggcuggccucauuagcaguagucauagccugcgccggagccgucacccgccgagggagcgcauacuacauguaccuagaccgcaacgacgccggagaagccauauccuuccccacuacacucggaaugaacaaaugcuacauccaaauaauggaccucggccacaugugcgacgccacgauguccuacgagugccccaugcucgacgaaggggucgaaccagacgacguagacugcuggugcaauaccacaucaaccuggguagucuacggaacuugccaccacaagaaaggcgaagcucgccgcagccgccgagccguaacccuaccaucccacagcacgcggaaacuacagacccgaagccaaacauggcucgaaagccgcgaauacacgaaacaccuaauaagagucgagaacuggaucuuccgaaaccccggauucgcccucgccgcagccgcaaucgcguggcuacucggcuccucgacgucccagaaaguaaucuaccuagugaugauacuacucauagccccagccuacucaauccgaugcaucggggucagcaaccgggacuucguagaagggaugagcggcggaaccuggguagacauaguccuagaacacggcgggugcgugacagucauggcccaagacaaaccgacaguagacauagagcuagucaccaccacgguaaguaacauggccgaaguccgcagcuacuguuacgaagcaagcaucucagauauggccagcgacucaagaugcccaacacaaggggaagcauaccucgacaaacaaagcgacacacaguacgucuguaaacgcacccuaguagaucgaggauggggcaacggcugcggacuauucgggaaaggcagccucguaaccugcgccaaauucgccugcuccaagaaaaugaccgggaaaucgauacaaccagaaaaccucgaauaccgcauaaugcugaguguacacggcagccagcacagcgggaugauagugaacgacacaggccacgaaacggacgaaaaccgcgcuaaaguagaaaucaccccaaacucaccccgagcugaagcuacccuagggggcuucggcagucugggacuagacugcgaacccagaaccggccuugacuucagcgaccucuacuaccuuaccaugaacaacaaacacuggcucguccacaaagagugguuccacgacaucccccucccauggcaugccggagcagacacgggcacaccccacuggaacaauaaggaagcccucguagaguucaaagacgcccacgccaaacgccaaaccguaguaguccucggcucccaagaaggagcaguucacacagcacucgcgggcgcccucgaagcagaaauggacggcgccaaaggccgccucagcagcggacaccuaaagugccgacuaaaaauggacaagcuacgccucaaaggggucuccuacagccucugcacggccgccuucaccuucacaaaaauaccagcggaaacacuccacggcacaguaaccgucgagguacaauacgccggcaccgacggccccugcaaaguaccagcccaaauggccgucgacaugcaaacccucacacccgucggacgacuaauaaccgcuaacccagucauuacagaauccaccgaaaacaguaagaugaugcucgagcucgacccgcccuucggcgacucauacaucguaauaggcgucggcgagaagaagauaacccaccacuggcaccgcucaggaagcaccauaggcaaagccuucgaagcgacaguacgaggcgcaaaaagaauggcgguccuaggagauaccgccugggacuucggcucagucggaggagcacuaaacagccuaggcaaaggaauccaccaaaucuucggugccgccuucaagucgcuauucggaggcauguccugguucagucaaauccucaucggcaccuuauuaauguggcuaggacugaacacuaaaaacggaaguaucagccucaugugucuagcccucggcggaguacuaaucuuccucucgacagccgucuccgcg

SEQ ID NO: 11177 - RNA, 2100 nt, Artificial Sequence
  ZIKV (isolate Z1106033) ME variant CDS opt
augggacgaaagcaaaacaagcgcggagggaacgaaggauccaucaugugguuagccucacucgcaguagucauagccugcgccggcgccgucacaagaagaggauccgccuacuacauguaccuugaccgaaacgacgcaggcgaagccaucuccuuccccacaacccuggggaugaacaaaugcuacauacaaauaauggaccucggccauaccugcgacgcaaccaugagcuacgaaugcccaaugcuagaugaaggcguagaacccgacgacguugacugcuggugcaacacaaccuccacguggguuguauacggaaccugccaccacaagaaaggcgaggcacgccgcagccgacgagcagucacacuacccagccacaguacaagaaaacuccaaacgcgaagccaaacauggcucgagagcagagaauacaccaaacaccucaucaggguagagaacuggauauucagaaaccccgguuucgcccucgcagcugcagccauagccuggcucuugggcucauccaccagccaaaaaguaaucuaccuggugaugauauuacucaucgcccccgcguacucgaucagaugcaucgguguuuccaaccgagacuucgucgaagggaugagcggcggaaccuggguagacguaguccucgaacacggaggaugcgucacaguaauggcccaagacaaacccacagucgacauagagcuaguuaccaccaccguaaguaauauggcagaagugcgcucauacugcuacgaagcaucaaucucugacauggccucugacucccgaugccccacacagggagaggccuaccuagacaaacaauccgacacccaauacguaugcaaacgaacacucgucgaccgcggcuggggcaacgggugcggacuauucggaaaaggaucacucguaaccugcgccaaauucgccugcucaaagaaaaugacaggcaaaagcauccaacccgaaaaccucgaauaccgcaucaugcucuccguccacggaucccagcacuccggcaugauagucaacgacaccggacacgagacagacgaaaaccgcgcaaaagucgaaaucacaccaaacagcccccgagcagaagcaacacucggaggcuucgguucccucggccuugacugcgaacccagaacaggccuagauuucagcgaccucuacuaucucaccaugaacaacaaacacuggcucguccauaaagagugguuccacgacaucccccuacccuggcacgccggagccgauaccggcaccccacacuggaacaacaaagaagcccucgucgaguucaaagacgcgcacgcgaaaagacaaaccgucgucguccugggcucccaagaaggggcaguccacacugcccucgccggugcacuagaagcagaaauggacggcgcaaagggccgacugaguagcggucaccugaaaugcagacucaaaauggacaaacuccgacucaaaggagucucauacucacuaugcaccgccgcguucacauuuacaaaaauacccgcggaaacgcugcacggcacagugaccguagaaguacaauacgccggcaccgacggaccaugcaaagucccagcccaaauggcagucgacaugcaaacucucaccccaguuggccgacuaauaacagcaaacccuguaauaacagaaucaacagagaacuccaaaaugaugcucgaacucgacccgcccuucggagacagcuacauagucaucggggucggcgagaaaaagauuacccaccacuggcacaggagcgggagcaccaucggcaaagcauucgaagccacagucagaggcgcgaaacgcauggccguccuuggcgacacagcaugggauuucggaagcguaggcggggcauuaaacucacucggaaaaggcauacaccagaucuucggagccgccuucaaaagccuauucgggggcaugaguugguucucccaaauacuuaucggaacacuacucauguggcuaggccucaacgccaaaaacgguucuauaucacuaaugugccuagcccucggcggcguccuaaucuuccucagcacggccgucucagcc

SEQ ID NO: 11178 - RNA, 2088 nt, Artificial Sequence
  ZIKV (strain MR 766) ME variant CDS opt
augggucgcaaacaaaacaaacgaggcgggaacgaaggcagcauaauguggcucgccucccucgcagucgucauugccugcgcgggggcaauaacacggagaggaucggccuacuacauguaccuagaccgcagcgaugcaggaaaagcgaucagcuucgcgaccacgcuaggcgucaacaaaugccacguacaaaucauggaccucggacacaugugcgacgcaacaaugucauacgaaugccccaugcuagacgaaggaguagaaccagacgacguagacugcuggugcaacaccacgagcacaugggucguauacggcacaugccaccacaagaaaggggaagcgcgccgcagccgacgcgcagucacacuuccaagccacagcacacgcaagcuccaaacccgaagccagacauggcucgaaagccgggaauacaccaaacaccugaucaaaguagagaacuggaucuuccgaaaucccggcuucgcccucguagccguggccaucgcguggcuccugggaucgagcacaagccaaaaaguaaucuaccugguaaugauacuccuaaucgcucccgcauacucaaucagaugcaucggcguaagcaaucgcgacuucgucgaaggcaugagcgggggaaccuggguagacgucguacucgagcacggcggcugugucaccgugauggcccaggacaagccaacagucgacaucgagcuaguaaccacaaccguguccaacauggcagaaguacgaucauacugcuacgaggcauccaucucagacauggcaucagacucgcgcugucccacacaaggcgaagcguaccuagacaaacaaucagacacccaguacguaugcaaacgaacccuagucgaccgcggauggggcaacggaugugggcuauuuggcaaaggcucacucgugaccugcgcaaaauucacaugcagcaagaaaaugaccggaaaaagcauccaaccggaaaaccucgaauaccggauaaugcugucgguccacgggagucagcacagcggcaugauaggauacgaaacagacgaggacagagcaaaagucgaagucacaccaaacuccccgcgggcagaggccacccuggguggcuucggcagccuaggacuggacugcgaaccacgcacaggccuagacuucuccgaccuauacuaccuaacaaugaacaacaaacacuggcuagugcacaaagaaugguuccacgacaucccccuccccuggcacgcaggcgcagauaccggaacaccacacuggaacaacaaggaggcccuaguagaguucaaagacgcacacgccaaacgacaaacuguaguaguccugggaucccaagaaggugcgguacauacagcccucgcaggcgcacuggaagcagaaauggacggagcaaaagggcgccucuucuccggccaccuaaagugccgccuuaaaauggacaaacugagacugaaaggugucagcuacagucuaugcaccgccgccuucaccuucaccaaaguccccgccgaaacccugcacggaaccguaacagucgaaguacaauacgccggcaccgacggaccgugcaaaauaccaguccaaauggcgguugacaugcaaacucuaacccccgucgggcgccuaauaacagcaaauccggucaucacggaaucaaccgaaaauucaaagaugaugcuugaacuagacccacccuucggcgacagcuacauagucauaggagucggagacaagaaaauaacccaccacuggcaccgaucgggcuccacaaucggaaaagccuucgaagccacgguaagaggagcaaaacgaauggccguacuuggggacacagcgugggacuucgggagcgucggaggagucuucaacucacuagggaagggaauccaccaaauauucggagccgcguucaaaucacuguucggaggaaugagcugguucucccaaauacuuaucggcacacuccucgucuggcucggacuaaacaccaaaaacggcagcauaagccugacaugucucgcguuaggcggaguaaugauauuccucuccacagccgucagcgca

SEQ ID NO: 11179 - RNA, 2100 nt, Artificial Sequence
  ZIKV (strain NatalRGN) ME variant CDS opt
augggccgaaaacaaaacaaaagaggaggcaacgaaggcagcaucaugugguuagccucccuggccguagucaucgccugcgcaggcgccguaacccgccgcggcucagcauauuacauguaccuggaccgaaaugacgccggcgaagccauauccuucccaacgacacuaggaaugaacaaaugcuacauccaaaucauggaccucggccacaugugcgacgcaacaauguccuaugaaugcccaaugcuggacgaaggcguagaacccgacgacguagacugcugguguaacaccaccaguacaugggugguauacggcacaugccaccacaagaaaggcgaagcgcgcagauccaggcgcgcagucaccuuaccuagccacagcaccagaaaacuacaaacccgaagucaaaccuggcuagaauccagagaauacaccaaacaccugauccgcgucgagaauuggaucuuccgcaaccccggauucgcacucgcagccgcagcaaucgcauggcuacuggggucuuccacaucgcaaaaggugaucuaccugguaaugauccuccucauagcucccgcguacucaaucaggugcaucggaguauccaacagagacuucguagaaggaauguccggcgggaccugggucgauguaguacuugaacacggggguugcguaacggucauggcacaagacaaaccaaccguagacauagagcucgucacaaccacagucagcaacauggcggaaguucgaucauacuguuacgaagccagcauaucagacauggccucggacagccgaugcccaacacaaggagaggcauaccucgacaaacagagcgacacacaauacguaugcaaacgcaccuuggucgaccgcggcuggggaaacggaugcggacucuucggaaaaggcucccuaguaaccugcgccaaauucgcuugcucaaagaaaaugaccggaaaaagcauacaaccagaaaaccuugaauaccgaauaaugcucucgguccacggcucacaacacagcggaaugauagucaacgacacgggccacgaaaccgaugagaacagagccaaagucgagaucacaccaaacagcccccgagcagaggcaacacucggcggguucgguagccuaggacuagacugcgaaccacgaaccggcuuagacuucagcgaccuuuacuaucuaaccaugaacaacaaacacuggcucguccacaaagaaugguuccacgacaucccacuccccuggcacgcaggagccgacaccggcacuccccacuggaacaacaaagaagcccuagucgaguucaaagacgcacacgcaaaacgccaaaccgucgucguacugggcucacaggaaggagccguacacaccgcacuagccggagcgcucgaagcagaaauggacggcgcaaagggcagacuaucaagcggccaccugaaaugcaggcuaaaaauggacaaacuccgacucaaaggagucuccuacagccucugcacagcugccuucacauucaccaagaucccagccgaaacccugcacggaacagucaccgucgaaguacaguacgccggaaccgacggccccugcaagguacccgcccaaauggccgucgacaugcagacccugacaccaguaggacgacucauaacugcaaauccaguaaucaccgaaucaaccgaaaacucgaagaugaugcuggaacucgaucccccauucggcgacuccuacaucgucauaggggucggcgagaaaaagauaacccaccacuggcaccgcagcggcagcaccauaggaaaagcguucgaagcaaccguaagaggagcuaaaagaauggcagugcugggcgacacagccugggacuucggcucagugggaggcgccuuaaacucgcucggaaaaggcauccaccagauauucggagcagcauucaagagccucuucggcggaaugaguugguucucucaaauccucaucggcacccucuugauguggcucggccuaaacaccaaaaacggaagcaucucccucaugugccucgcccuaggaggcguccucauauuccuaagcacagcaguauccgca

SEQ ID NO: 11180 - RNA, 2073 nt, Artificial Sequence
  ZIKV (strain ZikaSPH2015) ME variant CDS opt
augaacgaaggcuccauuauguggcuagcaucacuagcggucgucaucgccugcgccggcgccgucaccagacgcggcuccgcuuacuacauguaccuggaccgaaacgacgccggagaagcgauauccuucccaacaacacucgguaugaacaaaugcuacauccaaauaauggaccucggccacaugugcgacgcaaccaugucauacgaaugccccaugcuggacgaaggagucgaacccgacgacgucgacugcuggugcaacacaacaagcaccugggucgucuauggcacaugccaccacaagaaaggggaagcccggcgcagcaggcgcgcgguaacacuccccagccacuccacccgaaaacuccaaacccgcagucagacauggcucgaaucccgcgaauacaccaaacaccugauccgcguugaaaacuggaucuucagaaacccaggcuucgcccucgccgccgcagcaaucgccuggcuacugggcuccucgacaagucaaaaagucauuuaccuaguaaugauccuccuuauagccccagccuacucaaucagaugcaucggggucuccaaccgagacuucguagaaggaaugucgggcggaacauggguagacaucguccucgaacacggcggaugcguaaccgugauggcccaagacaaaccaacagucgacauagagcuagucacaacaacaguaucaaacauggccgaaguacgauccuacugcuacgaagccucuaucucagacauggcgucggacagccgcugcccgacacaaggcgaagccuaccuagacaagcaaucggacacccaauacgucugcaaacggacccuugucgaccguggcuggggcaacggcugcggccuauucggcaaaggaucacucguaaccugcgccaaguucgcaugcuccaagaaaaugacgggcaaaagcauccagcccgaaaaccuagaauaccgaaucaugcucucaguccacggcucacaacacagcggcaugauagucaacgacacuggacacgaaaccgacgaaaacagagccaaagucgaaaucacccccaacagccccagagcggaagcuacgcucggcggcuucgguucccucggccuagacugcgagcccagaaccggccucgacuucagcgaccucuacuaccucacaaugaacaacaaacauuggcugguccacaaagaaugguuccacgacauaccgcuaccauggcaugcaggcgccgacacuggaacgccccacuggaacaacaaagaggcacucgucgaguucaaagacgcacacgcaaaacgccaaaccgucgucguacuaggcucacaagaaggcgccguccauaccgcacucgcaggggcacuggaagccgagauggauggagccaaaggccgacucagcuccggccaccucaaaugccgacuaaaaauggacaaacuacgacuaaaaggcgucucuuacucacuauguaccgcagcauuuacauucacgaagaucccagcugaaacccuccacggaaccguaaccgucgagguccaauacgccggaaccgacggcccaugcaaggucccagcccagauggccguagacaugcaaacccuaacaccuguaggaagacuaaucaccgcaaaccccguaaucaccgaauccaccgaaaacagcaaaaugaugcucgaacuggacccacccuuuggcgacuccuacauagugauuggcgucggugagaaaaagauaacccaccacuggcacaggagcggcagcaccauaggcaaagccuucgaagcuacagucagaggagcaaaaagaauggccguccucggcgacacagccugggacuucgguuccgucggcggcgcccuaaacucgcuuggaaagggcauccaccaaauauucggcgcagcauucaaaucacuauucggcgggaugucaugguucucccaaauacucauuggcacucuccuaauguggcuaggccucaacaccaaaaacggcucuaucagccucaugugccucgcccuagguggcguacuaauauuccucucgaccgcaguaucagca

SEQ ID NO: 11181 - RNA, 2073 nt, Artificial Sequence
  ZIKV (isolate Z1106033) ME variant CDS opt
augaacgagggcucuaucauguggcuagcaucccucgccgucgucauugcaugcgcaggagcaguaacacgacggggcucggcauacuacauguaccuagacagaaacgacgccggggaggcaaucuccuuccccaccacgcucggcaugaacaaaugcuacauacaaauaauggaccuaggacauaccugcgaugcaacaauguccuacgaaugccccaugcucgacgaaggaguagaaccagacgacgucgacugcuggugcaauacgacaaguacuuggguggucuacggcacaugccaccacaagaaaggcgaagcacgcagaagccgccgcgcgguuacccucccaagccacucaacgcgaaagcuccaaacacgaagccaaacauggcuagaaucccgagaauacacaaagcaccugaucagggucgaaaacuggaucuuccgaaauccaggauucgcacucgcagccgccgcaauagcauggcuacuaggcucuagcacaagccaaaaaguaaucuaccucguaaugauucuccucaucgccccagccuacucaaucagaugcaucggcguaagcaaccgcgacuucgucgaaggaaugucaggcggaacuugggucgacguaguccuagagcacggaggcugcgugacaguaauggcccaagauaagcccacagucgauaucgaauuagucacaaccaccgucuccaauauggcagaaguacgaucguacugcuacgaagcauccauaucagacauggccuccgacucgcgcugccccacccaaggagaagcguaccuagacaaacaauccgacacgcaauacgucugcaaaagaacgcugguagaccgaggcuggggcaacggaugcggccucuucggcaaaggcucacuggucaccugugcaaaguucgccugcuccaagaaaaugacaggcaaaagcauacagccggaaaaccucgaguaccggauaaugcuauccguccacggcagccaacacucagggaugauagucaacgacaccggccacgaaacagacgaaaaccgagccaaggucgaaaucacacccaacucaccccgcgccgaagcaacccugggaggcuucggaucccucgggcucgacugcgagccccgcaccggccuagacuucagcgaccucuacuaccucacaaugaacaacaaacacuggcuaguacacaaggaaugguuccaugacauaccacuccccuggcacgcaggagcggacacaggcaccccacacuggaacaacaaggaagcccugguugaguucaaggacgcgcacgcaaaacgucaaacagucguagugcucggcucccaagaaggagccguccauaccgcccuagccggagcgcucgaggccgaaauggacggagcaaagggacgccuaagcuccggccaccuaaaaugccggcuaaaaauggacaaauuacgccuaaaaggcgucucauacucgcuaugcaccgcagccuucacauucacaaaaauccccgccgaaacacugcacggaacaguaaccgucgaaguacaauacgccggaaccgacggccccugcaaagucccggcacaaauggccgucgacaugcaaacacugacuccagucggcagacucauaaccgcaaacccaguaauaacagaauccacugaaaacucgaaaaugauguuggaauuagacccacccuucggagacagcuacauagucaucggaguaggcgaaaagaaaauaacacaccacuggcacaggagcggcucaacaaucggcaaagccuucgaggcaacugucagaggcgccaaaagaauggccguacuaggcgacaccgcaugggauuucggaaguguaggaggagcccuaaacagccuaggaaaaggcauucaccaaauauucggagccgccuucaagucccuauucggaggcaugucaugguucagccaaauacucauaggaacguuacugauguggcucggccucaacgccaaaaacggaagcaucagccucaugugccucgcgcuaggaggaguccucauauuccugagcaccgcaguaagcgcc

SEQ ID NO: 11182 - RNA, 2061 nt, Artificial Sequence
  ZIKV (strain MR 766) ME variant CDS opt
augaacgaaggcagcaucauguggcuagcaucgcuggccgucgucaucgcaugcgcaggcgcgaucacccgcaggggaucagcauacuauauguaccuagaccgcagugacgccgguaaggcaaucagcuucgccacgacacucggcguaaacaaaugucacguacaaauaauggaccucggacacaugugcgacgccaccaugaguuacgaaugccccauguuagacgaaggaguagaacccgacgacguagacugcuggugcaacaccaccuccacaugggucgucuacggaaccugccaccacaagaaaggggaagcacgccgaucacggagggcagucacccugcccagccacagcacgcgaaaacugcaaacccgaagccaaaccugguuagaaucacgagaauacaccaaacaccucaucaaaguagaaaacuggauuuuccgaaacccggguuucgcccuaguagcaguagcaaucgcaugguuacucggaagcagcaccagccaaaaagucaucuaucuaguaaugauccuacuaaucgccccggccuacuccauaagaugcaucggagucuccaacagagacuucguagaagggaugucaggcgggacaugggucgacgucguccucgagcacggagggugcgugaccgucauggcccaagacaaacccacagucgacauagaacucgucaccacgacagucagcaacauggcagaagugcgcuccuauugcuaugaagccagcauaagcgacauggccucggacucacgcugcccgacgcagggagaagccuacuuagacaaacaauccgacacccaauacgugugcaaacggacacucgucgaccgcggguggggaaacggaugcggacuguucggaaagggcagccuggucacaugcgccaaguuuaccugcagcaaaaagaugacuggaaaaagcauacagccagaaaaccucgaauaccgcaucaugcuaagcguacacgggagucaacacuccggcaugauaggauacgaaaccgacgaagaccgugccaaaguagaaguaacccccaacagcccccgcgccgaggccacccuaggaggcuucggcagccuaggacucgacugcgagccccgcaccggccuggacuucagcgaccucuacuaccucacaaugaacaacaagcacuggcuaguacacaaggaaugguuccacgacauaccgcuacccuggcacgcaggcgccgacacaggcacaccccacuggaacaacaaggaagcccugguagaguucaaagacgcccacgcaaaacgccaaacaguaguagucuugggcucgcaagaaggagccguacacacagcacuagccggagcacucgaagcagaaauggacggcgcaaaaggccgccuauucagcggccaccucaagugccgacucaaaauggacaaacuccgacuuaaaggagugucguacagccucugcaccgcggccuucaccuucaccaaaguacccgccgaaacacuacacgguacagucaccgucgaaguccaauacgcaggaacagacggaccaugcaaaauucccguccaaauggccgucgacaugcaaacccucaccccuguaggacgacucauaacagcaaacccaguaauaacugaaagcaccgaaaacagcaaaaugaugcuagaacuagacccacccuucggugacaguuauaucguaauaggagucggagacaagaaaaucacacaccacuggcaccgaucaggaucaacaauuggcaaagccuucgaagccacaguaaggggcgcgaaacgcauggccguacucggagacaccgccugggacuucggaucaguaggcggcgucuucaacucccucggaaaaggcauacaccaaauuuucggugccgcguucaagagccucuucggcggaauguccugguucagccaaauacuaaucggaacgcuccuagucuggcucggauuaaacaccaaaaacggaagcauaucccugaccugccucgcacucggaggaguuaugaucuuccucucaaccgcagucagcgcc

SEQ ID NO: 11183 - RNA, 2073 nt, Artificial Sequence
  ZIKV (strain NatalRGN) ME variant CDS opt
augaacgaaggaagcauaauguggcuggcaucgcuagccguaguaauagcaugcgcaggcgcgguaacgcggcgggggucagccuacuacauguaccuagacagaaacgacgccggagaagccaucagcuuccccacaacacuaggaaugaacaaaugcuacauacaaauaauggaccuaggacacaugugcgacgcgacaauguccuacgagugcccgaugcuagacgaaggugucgaacccgacgacgucgacugcuggugcaacaccaccagcacauggguagucuacggcacaugccaccacaagaaaggagaagcacgacgcagccgccgcgcggucacccugccgagccacagcacacgaaaacugcaaacacggucacaaaccuggcuagaaagccgcgaguacacaaagcaccuuaucagaguagaaaacuggaucuuccgcaaucccggauucgcccuggcagcagccgccauagccuggcuacucggcucgagcaccagccaaaagguuaucuaccuagugaugauacuccucaucgcacccgcuuacuccauacguugcaucgggguaucaaaccgagacuucguagaaggcauguccggaggaaccugggucgacguaguucucgaacacggcgguugcgucacggucauggcucaggacaaaccaacagucgacaucgaacucgucaccacaaccgugagcaacauggccgaaguccgcaguuacugcuacgaggcaagcaucagcgacauggcaagcgacagccgaugccccacacaaggagaagcauaccuugacaaacagagcgacacccaauacgucugcaaacgaacauuggucgacagaggcuggggaaacggaugcggacuauucggaaaaggaagccuaguaaccugcgcaaaauucgccugcucaaagaaaaugaccgggaaaagcauacaacccgaaaaccuagaguaccgcauaaugcugagcguccacggcucacaacacuccggcaugauagucaacgacacgggccacgaaacagacgagaacagagccaaaguagaaaucacaccaaacagcccacgcgcagaagcaacccuaggagguuucgggagcuuaggacucgacugugaaccccgaaccggacucgacuucagcgaccuguacuaccucaccaugaacaacaaacacuggcuaguacacaaagaaugguuccacgacauaccacucccauggcacgccggggcagacacagguaccccgcacuggaacaacaaggaagcccuggucgaguucaaagacgcacacgcaaaaagacaaaccgucgugguacuaggaucacaagaaggagcgguccacacagcacucgccggagcgcuugaagcggaaauggacggagcaaaaggccgacucaguagcgggcaccuaaagugccggcuaaaaauggacaaacuccgacuaaaaggagucucauacucgcuaugcaccgccgccuucacguucacaaaaaucccagcugaaacccugcacggcaccguaaccguagagguccaauacgcaggaacugacgggccaugcaaaguacccgcacaaauggcagucgacaugcaaacacuaaccccuguaggccgccucauaacagcaaauccaguaaucaccgaaucaaccgaaaacagcaaaaugauguuagaacucgacccaccguucggcgacagcuacauagucauaggugucggcgagaaaaagaucacccaccacuggcaccgaucgggcucgaccaucggcaaagcauuugaagcuacaguacgaggcgcgaaacgaauggcgguccucggugacacagccugggacuucggaucaguaggcggggcacucaauuccuugggaaaaggaauccaccagaucuucggagcagcauucaaaucccuuuucgggggcaugagcugguucucccaaauacuaauaggcacacugcuaauguggcuaggacucaacaccaaaaacggcagcaucucccugaugugccucgcacuagguggcguacucaucuuccucuccacagcagucuccgca

SEQ ID NO: 11184 - RNA, 2320 nt, Artificial Sequence
  ZIKV (strain ZikaSPH2015) prME-short variant mRNA Design 1 wild type
gggagaaagcuuaccaugggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11185 - RNA, 2320 nt, Artificial Sequence
  ZIKV (isolate Z1106033) prME-short variant mRNA Design 1 wild type
gggagaaagcuuaccaugggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11186 - RNA, 2308 nt, Artificial Sequence
  ZIKV (strain MR 766) prME-short variant mRNA Design 1 wild type
gggagaaagcuuaccaugggcagaaagcaaaacaaaagaggaggaaaugaaggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11187 - RNA, 2320 nt, Artificial Sequence
  ZIKV (strain NatalRGN) prME-short variant mRNA Design 1 wild type
gggagaaagcuuaccaugggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11188 - RNA, 2293 nt, Artificial Sequence
  ZIKV (strain ZikaSPH2015) prME-short variant mRNA Design 1 wild type
gggagaaagcuuaccaugaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11189 - RNA, 2293 nt, Artificial Sequence
  ZIKV (isolate Z1106033) prME-short variant mRNA Design 1 wild type
gggagaaagcuuaccaugaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11190 - RNA, 2281 nt, Artificial Sequence
  ZIKV (strain MR 766) prME-short variant mRNA Design 1 wild type
gggagaaagcuuaccaugaaugaaggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11191 - RNA, 2293 nt, Artificial Sequence
  ZIKV (strain NatalRGN) prME-short variant mRNA Design 1 wild type
gggagaaagcuuaccaugaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11192 - RNA, 2320 nt, Artificial Sequence
  ZIKV (strain ZikaSPH2015) prME-short variant mRNA Design 1 wild type
gggagaaagcuuaccaugggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11193 - RNA, 2320 nt, Artificial Sequence
  ZIKV (isolate Z1106033) prME-short variant mRNA Design 1 wild type
gggagaaagcuuaccaugggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11194 - RNA, 2308 nt, Artificial Sequence
  ZIKV (strain MR 766) prME-short variant mRNA Design 1 wild type
gggagaaagcuuaccaugggcagaaagcaaaacaaaagaggaggaaaugaaggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11195 - RNA, 2320 nt, Artificial Sequence
  ZIKV (strain NatalRGN) prME-short variant mRNA Design 1 wild type
gggagaaagcuuaccaugggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11196 - RNA, 2293 nt, Artificial Sequence
  ZIKV (strain ZikaSPH2015) prME-short variant mRNA Design 1 wild type
gggagaaagcuuaccaugaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11197 - RNA, 2293 nt, Artificial Sequence
  ZIKV (isolate Z1106033) prME-short variant mRNA Design 1 wild type
gggagaaagcuuaccaugaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11198 - RNA, 2281 nt, Artificial Sequence
  ZIKV (strain MR 766) prME-short variant mRNA Design 1 wild type
gggagaaagcuuaccaugaaugaaggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11199 - RNA, 2293 nt, Artificial Sequence
  ZIKV (strain NatalRGN) prME-short variant mRNA Design 1 wild type
gggagaaagcuuaccaugaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11200 - RNA, 2320 nt, Artificial Sequence; identical to SEQ ID NO: 11184
  ZIKV (strain ZikaSPH2015) ME variant mRNA Design 1 wild type

SEQ ID NO: 11201 - RNA, 2320 nt, Artificial Sequence; identical to SEQ ID NO: 11185
  ZIKV (isolate Z1106033) ME variant mRNA Design 1 wild type

SEQ ID NO: 11202 - RNA, 2308 nt, Artificial Sequence; identical to SEQ ID NO: 11186
  ZIKV (strain MR 766) ME variant mRNA Design 1 wild type

SEQ ID NO: 11203 - RNA, 2320 nt, Artificial Sequence; identical to SEQ ID NO: 11187
  ZIKV (strain NatalRGN) ME variant mRNA Design 1 wild type

SEQ ID NO: 11204 - RNA, 2293 nt, Artificial Sequence; identical to SEQ ID NO: 11188
  ZIKV (strain ZikaSPH2015) ME variant mRNA Design 1 wild type

SEQ ID NO: 11205 - RNA, 2293 nt, Artificial Sequence; identical to SEQ ID NO: 11189
  ZIKV (isolate Z1106033) ME variant mRNA Design 1 wild type

SEQ ID NO: 11206 - RNA, 2281 nt, Artificial Sequence; identical to SEQ ID NO: 11190
  ZIKV (strain MR 766) ME variant mRNA Design 1 wild type

SEQ ID NO: 11207 - RNA, 2293 nt, Artificial Sequence; identical to SEQ ID NO: 11191
  ZIKV (strain NatalRGN) ME variant mRNA Design 1 wild type

SEQ ID NO: 11208 - RNA, 2320 nt, Artificial Sequence
  ZIKV (strain ZikaSPH2015) prME-short variant mRNA Design 1 opt
gggagaaagcuuaccaugggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11209 - RNA, 2320 nt, Artificial Sequence
  ZIKV (isolate Z1106033) prME-short variant mRNA Design 1 opt
gggagaaagcuuaccaugggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11210 - RNA, 2308 nt, Artificial Sequence
  ZIKV (strain MR 766) prME-short variant mRNA Design 1 opt
gggagaaagcuuaccaugggccggaagcagaacaagcgcgggggcaacgaggggagcaucauguggcuggccucccucgccguggucaucgcgugcgccggcgccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11211 - RNA, 2320 nt, Artificial Sequence
  ZIKV (strain NatalRGN) prME-short variant mRNA Design 1 opt
gggagaaagcuuaccaugggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11212 - RNA, 2293 nt, Artificial Sequence
  ZIKV (strain ZikaSPH2015) prME-short variant mRNA Design 1 opt
gggagaaagcuuaccaugaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11213 - RNA, 2293 nt, Artificial Sequence
  ZIKV (isolate Z1106033) prME-short variant mRNA Design 1 opt
gggagaaagcuuaccaugaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11214 - RNA, 2281 nt, Artificial Sequence
  ZIKV (strain MR 766) prME-short variant mRNA Design 1 opt
gggagaaagcuuaccaugaacgagggcagcaucauguggcuggccucccucgccguggucaucgcgugcgccggggccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11215 - RNA, 2293 nt, Artificial Sequence
  ZIKV (strain NatalRGN) prME-short variant mRNA Design 1 opt
gggagaaagcuuaccaugaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11216 - RNA, 2320 nt, Artificial Sequence
  ZIKV (strain ZikaSPH2015) prME-short variant mRNA Design 1 opt
gggagaaagcuuaccaugggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11217 - RNA, 2320 nt, Artificial Sequence
  ZIKV (isolate Z1106033) prME-short variant mRNA Design 1 opt
gggagaaagcuuaccaugggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11218 - RNA, 2308 nt, Artificial Sequence
  ZIKV (strain MR 766) prME-short variant mRNA Design 1 opt
gggagaaagcuuaccaugggccggaagcagaacaagcgcgggggcaacgaggggagcaucauguggcuggccucccucgccguggucaucgcgugcgccggcgccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11219 - RNA, 2320 nt, Artificial Sequence
  ZIKV (strain NatalRGN) prME-short variant mRNA Design 1 opt
gggagaaagcuuaccaugggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11220 - RNA, 2293 nt, Artificial Sequence
  ZIKV (strain ZikaSPH2015) prME-short variant mRNA Design 1 opt
gggagaaagcuuaccaugaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11221 - RNA, 2293 nt, Artificial Sequence
  ZIKV (isolate Z1106033) prME-short variant mRNA Design 1 opt
gggagaaagcuuaccaugaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11222 - RNA, 2281 nt, Artificial Sequence
  ZIKV (strain MR 766) prME-short variant mRNA Design 1 opt
gggagaaagcuuaccaugaacgagggcagcaucauguggcuggccucccucgccguggucaucgcgugcgccggggccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11223 - RNA, 2293 nt, Artificial Sequence
  ZIKV (strain NatalRGN) prME-short variant mRNA Design 1 opt
gggagaaagcuuaccaugaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11224 - RNA, 2320 nt, Artificial Sequence; identical to SEQ ID NO: 11208
  ZIKV (strain ZikaSPH2015) ME variant mRNA Design 1 opt

SEQ ID NO: 11225 - RNA, 2320 nt, Artificial Sequence; identical to SEQ ID NO: 11209
  ZIKV (isolate Z1106033) ME variant mRNA Design 1 opt

SEQ ID NO: 11226 - RNA, 2308 nt, Artificial Sequence; identical to SEQ ID NO: 11210
  ZIKV (strain MR 766) ME variant mRNA Design 1 opt

SEQ ID NO: 11227 - RNA, 2320 nt, Artificial Sequence; identical to SEQ ID NO: 11211
  ZIKV (strain NatalRGN) ME variant mRNA Design 1 opt

SEQ ID NO: 11228 - RNA, 2293 nt, Artificial Sequence; identical to SEQ ID NO: 11212
  ZIKV (strain ZikaSPH2015) ME variant mRNA Design 1 opt

SEQ ID NO: 11229 - RNA, 2293 nt, Artificial Sequence; identical to SEQ ID NO: 11213
  ZIKV (isolate Z1106033) ME variant mRNA Design 1 opt

SEQ ID NO: 11230 - RNA, 2281 nt, Artificial Sequence; identical to SEQ ID NO: 11214
  ZIKV (strain MR 766) ME variant mRNA Design 1 opt

SEQ ID NO: 11231 - RNA, 2293 nt, Artificial Sequence; identical to SEQ ID NO: 11215
  ZIKV (strain NatalRGN) ME variant mRNA Design 1 opt

SEQ ID NO: 11232 - RNA, 2320 nt, Artificial Sequence
  ZIKV (strain ZikaSPH2015) prME-short variant mRNA Design 1 opt
gggagaaagcuuaccaugggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11233 - RNA, 2320 nt, Artificial Sequence
  ZIKV (isolate Z1106033) prME-short variant mRNA Design 1 opt
gggagaaagcuuaccaugggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11234 - RNA, 2308 nt, Artificial Sequence
  ZIKV (strain MR 766) prME-short variant mRNA Design 1 opt
gggagaaagcuuaccaugggccgcaagcagaacaagcgcggcggcaacgagggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11235 - RNA, 2320 nt, Artificial Sequence
  ZIKV (strain NatalRGN) prME-short variant mRNA Design 1 opt
gggagaaagcuuaccaugggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11236 - RNA, 2293 nt, Artificial Sequence
  ZIKV (strain ZikaSPH2015) prME-short variant mRNA Design 1 opt
gggagaaagcuuaccaugaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11237 - RNA, 2293 nt, Artificial Sequence
  ZIKV (isolate Z1106033) prME-short variant mRNA Design 1 opt
gggagaaagcuuaccaugaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11238 - RNA, 2281 nt, Artificial Sequence
  ZIKV (strain MR 766) prME-short variant mRNA Design 1 opt
gggagaaagcuuaccaugaacgagggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11239 - RNA, 2293 nt, Artificial Sequence
  ZIKV (strain NatalRGN) prME-short variant mRNA Design 1 opt
gggagaaagcuuaccaugaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11240 - RNA, 2320 nt, Artificial Sequence
  ZIKV (strain ZikaSPH2015) prME-short variant mRNA Design 1 opt
gggagaaagcuuaccaugggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11241 - RNA, 2320 nt, Artificial Sequence
  ZIKV (isolate Z1106033) prME-short variant mRNA Design 1 opt
gggagaaagcuuaccaugggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11242 - RNA, 2308 nt, Artificial Sequence
  ZIKV (strain MR 766) prME-short variant mRNA Design 1 opt
gggagaaagcuuaccaugggccgcaagcagaacaagcgcggcggcaacgagggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11243 - RNA, 2320 nt, Artificial Sequence
  ZIKV (strain NatalRGN) prME-short variant mRNA Design 1 opt
gggagaaagcuuaccaugggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11244 - RNA, 2293 nt, Artificial Sequence
  ZIKV (strain ZikaSPH2015) prME-short variant mRNA Design 1 opt
gggagaaagcuuaccaugaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11245 - RNA, 2293 nt, Artificial Sequence
  ZIKV (isolate Z1106033) prME-short variant mRNA Design 1 opt
gggagaaagcuuaccaugaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11246 - RNA, 2281 nt, Artificial Sequence
  ZIKV (strain MR 766) prME-short variant mRNA Design 1 opt
gggagaaagcuuaccaugaacgagggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11247 - RNA, 2293 nt, Artificial Sequence
  ZIKV (strain NatalRGN) prME-short variant mRNA Design 1 opt
gggagaaagcuuaccaugaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11248 - RNA, 2320 nt, Artificial Sequence; identical to SEQ ID NO: 11232
  ZIKV (strain ZikaSPH2015) ME variant mRNA Design 1 opt

SEQ ID NO: 11249 - RNA, 2320 nt, Artificial Sequence; identical to SEQ ID NO: 11233
  ZIKV (isolate Z1106033) ME variant mRNA Design 1 opt

SEQ ID NO: 11250 - RNA, 2308 nt, Artificial Sequence; identical to SEQ ID NO: 11234
  ZIKV (strain MR 766) ME variant mRNA Design 1 opt

SEQ ID NO: 11251 - RNA, 2320 nt, Artificial Sequence; identical to SEQ ID NO: 11235
  ZIKV (strain NatalRGN) ME variant mRNA Design 1 opt

SEQ ID NO: 11252 - RNA, 2293 nt, Artificial Sequence; identical to SEQ ID NO: 11236
  ZIKV (strain ZikaSPH2015) ME variant mRNA Design 1 opt

SEQ ID NO: 11253 - RNA, 2293 nt, Artificial Sequence; identical to SEQ ID NO: 11237
  ZIKV (isolate Z1106033) ME variant mRNA Design 1 opt

SEQ ID NO: 11254 - RNA, 2281 nt, Artificial Sequence; identical to SEQ ID NO: 11238
  ZIKV (strain MR 766) ME variant mRNA Design 1 opt

SEQ ID NO: 11255 - RNA, 2293 nt, Artificial Sequence; identical to SEQ ID NO: 11239
  ZIKV (strain NatalRGN) ME variant mRNA Design 1 opt

SEQ ID NO: 11256 - RNA, 2320 nt, Artificial Sequence
  ZIKV (strain ZikaSPH2015) prME-short variant mRNA Design 1 opt
gggagaaagcuuaccaugggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacaugugcgaugccacgaugaguuacgaguguccuauguuagacgaagggguggagccagaugacguagauugcugguguaacaccacaagcacuuggguggucuauggaaccugccaucacaaaaagggcgaagcucguagauccaggcgggcagugacacugccgucucauucgacccgcaaacuacagacuagaucacagacauggcucgagagcagggaguacaccaagcaccugauccggguugaaaauuggauuuuucgcaaccccggcuucgcccuugcugccgcggcaaucgccuggcuguuggggaguuccacgucucagaaggugauauaucucgucaugauccugcugauugcuccugccuacagcauccgauguauuggaguguccaauagagacuuuguagaggguaugucaggcgggacuuggguugauaucgugcucgaacauggaggcugcgucaccgugauggcacaagacaaaccaacaguggauauagaguuagucacuaccacaguuaguaacauggcugaggugaggagcuacuguuaugaagccucuauuuccgacauggcgucagauagccggugccccacccagggugaggccuaccuggacaagcagagugacacgcaguauguauguaaacguacucuuguggaucgcggguggggaaauggcugcggcuuguucgggaagggaucucuggucacaugcgcaaaauuugcuuguuccaagaagaugaccgguaaaagcauccaaccugaaaaccuagaguacagaauuaugcucucggugcacggcucucagcacuccgggaugaucguuaaugacacuggacaugaaacagaugagaacagggccaagguggagaucaccccaaauucaccccgggcugaagccacgcugggcgguuucgggagucuuggccuggacugcgagccucgaaccggauuggauuuuagcgaccucuauuaccugacaaugaacaauaaacacugguuaguccauaaggaaugguuccacgauauuccacugccguggcacgcaggcgccgacacugggacaccccauuggaacaacaaagaggcucucguggaauuuaaggaugcgcacgcaaaacgccagaccguaguugugcuuggaucccaggagggugccguccauacugcucuggccggcgcauuggaggccgaaauggacggggcuaagggaagacuaucuagcggccaccugaaguguaggcucaaaauggauaagcugcggcuuaaaggugugucauauagucugugcaccgccgcauucacauuuaccaagauaccugcggagacuuugcaugggacggucacaguggaaguucaauacgcuggcaccgacggaccauguaaagugcccgcccagauggcaguagacaugcagacucucaccccugucggccgccugaucacagccaauccagugauuaccgaguccacugaaaacagcaagaugauguuagagcuggaucccccguucggggacucuuacaucguuauaggagugggugagaagaaaauuacacaccacuggcauagaucaggcaguacgaucgggaaggcuuuugaagccaccgucaggggagcaaaacguauggcugugcuaggcgauacugccugggacuucgguagcguagggggcgcgcucaauucccugggaaagggcauccaccaaauuuucggggccgcuuuuaaaucucuuuucggaggcaugucgugguuuagccagaucuugauugguacacugcucauguggcuggggcuuaacaccaagaauggauccauaucacugaugugcuuggcacucggcggugugcugaucuucuuaaguacagccguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11257 - RNA, 2320 nt, Artificial Sequence
  ZIKV (isolate Z1106033) prME-short variant mRNA Design 1 opt
gggagaaagcuuaccaugggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacacgugcgaugccaccaugaguuacgaguguccuauguuagacgaagggguggagccagaugacguagauugcugguguaacacaacuagcaccuggguggucuauggaacaugccaucacaaaaagggcgaagcucguagauccaggcgggcagugacccugccgucucauucgacucgcaaacuacagacaagaucacagaccuggcucgagagcagggaguacacgaagcaccugauccggguugaaaauuggauuuuucgcaaccccggcuucgcccuugcugccgcggcaaucgccuggcuguuggggaguuccacuucucagaaggugauauaucucgucaugauccugcugauugcuccugccuacagcauccgauguauuggaguguccaauagagacuuuguagaggguaugucaggcgggaccuggguugaugugguccucgaacauggaggcugcgugacagugauggcacaagacaaaccaacugucgauaucgaguuaguuaccacaaccgugaguaacauggcugagguaaggagcuacuguuaugaagccucuauauccgacauggcgucagauagccggugccccacgcagggugaggccuaccuggacaagcagagugacacucaguauguguguaaacguacacuugucgaucgcggguggggaaauggcugcggcuuguucgggaagggaucucuggugaccugcgcaaaauuugcuuguuccaagaagaugacugguaaaagcauucaaccugaaaaccuagaguacagaaucaugcucucgguucacggcucucagcacuccgggaugauugugaaugacacaggacaugaaaccgaugagaacagggccaaggucgagaucacgccaaauucaccccgggcugaagccacccugggcgguuucgggagucuuggccuggacugcgagccucgaacaggauuggauuuuagcgaccucuauuaccugacuaugaacaauaaacacugguuagugcauaaggaaugguuccacgauaucccacugccguggcacgcaggcgccgacaccgggacaccccauuggaacaacaaagaggcucucguagaauuuaaggaugcgcacgcaaaacgccagacuguugugguccuuggaucccaggagggugccgugcauaccgcucuggccggcgcauuggaggccgaaauggacggggcuaagggaagacuaucuagcggccaccugaaguguaggcucaaaauggauaagcugcggcuuaaaggugucucauauagucugugcacagccgcauucaccuuuacuaagauuccugcggagacguugcaugggacagugaccguugaagugcaauacgcuggcacugacggaccauguaaaguacccgcccagauggcagucgacaugcagacccucacaccugugggccgccugauaaccgccaauccaguuaucacugaguccacagaaaacagcaagaugauguuagagcuggaucccccguucggggacucuuacauugugaucggagucggugagaagaaaauaacgcaccacuggcauagaucaggcaguaccauugggaaggcuuuugaagccacugugaggggagcaaaacguauggcuguacuaggcgauacagccugggacuucgguagcguugggggcgcgcucaauucccugggaaagggcauccaccaaaucuucggggccgcuuuuaaaucucuuuucggaggcaugucgugguuuagccagauuuugaucgguacccugcucauguggcuggggcuuaacgcaaagaauggauccauuucacugaugugcuuggcccucggcggugugcugauauucuuaaguacagcugucucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11258 - RNA, 2308 nt, Artificial Sequence
  ZIKV (strain MR 766) prME-short variant mRNA Design 1 opt
gggagaaagcuuaccaugggcagaaagcagaacaaaaggggagggaaugaggguagcaucauguggcuggccucccucgcuguggucauugcaugcgccggcgcgauaacccggcgcgggucugcuuacuauauguaccuugaccgaucagaugccggaaaggcaaucaguuucgccacaacucugggcguuaacaaaugucacgugcaaauuauggacuugggucauaugugcgaugcuacgaugagcuaugaaugucccauguuagacgaggggguagaaccugaugacguggauugcugguguaauaccacauccacuugggucguguacggaaccugccaccauaagaaaggcgaggcacguagaucuaggcgggccguuacacugccaucgcacucaacccgcaagcuacagacuagaagccagacauggcucgaaaguagggaguauaccaagcaucugaucaaaguggagaacuggauuuuucggaauccgggcuucgcucuugucgccguggcgaucgcauggcuguugggguccucuacgagccagaagguaauauaccucguuaugauccugcugauugcccccgcuuauuccauccgcuguauuggagugucaaaccgagacuuugucgaagguaugaguggcgggacuuggguggaugugguccucgagcacggaggcugcguuaccgugauggcccaagacaaaccuacaguagauaucgaauuagugacuaccacagucagcaauauggcagaggugagaucuuacuguuacgaggcuuccauaucagacauggccagcgauaguaggugcccaacccagggugaagcguaucuggacaagcagucugacacgcaguacguuuguaaacggacucuuguggaucguggguggggaaacggcugcggcuuguucgggaagggaucccuggucacaugcgccaaguuuaccuguagcaaaaagaugacugguaaaucgauucaacccgagaaucuagaauaucgcaucaugcucucugugcacggcucccagcauucagggaugauuggauacgagacagacgaagauagagcaaagguagagguuaccccuaacaguccaagggcugaggccacgcugggcgguuucgggagccuuggccuggacugcgaaccccggaccggauuggauuuuuccgaccucuauuaccugacaaugaauaacaaacacugguuagugcauaaggagugguuccacgauaucccucugccauggcacgcuggcgccgacacugggaccccgcauuggaauaacaaagaagcacucgucgaguuuaaggaugcccacgcuaagcgacagacaguggucgugcuuggaucucaggaaggugcgguucauacugcacuggccggcgcuuuggaggccgagauggacggggcaaaaggacgccuauucagcggccaccugaaguguagacucaaaauggauaagcugaggcuuaaaggugugucauauagucugugcaccgccgcuuuuacauucaccaagguacccgccgaaacuuugcaugggacggucacaguggagguucaauacgcaggcaccgacggaccuuguaagaucccagugcagauggcggucgacaugcagacucucacccccgugggccggcugauuacagcuaauccuguaauaaccgaauccacugagaacagcaaaaugauguuagaacuggauccacccuuuggggacucuuacaucgugauuggaguuggugauaagaaaaucacacaccacuggcaucgcucaggcaguacgauagggaaggccuucgaggcaaccgucagaggagccaaaaggauggcugugcuaggcgacacugccugggauuucgguagcgucgggggcguguuuaacucccucggaaagggcauucaccaaaucuucggggcagcuuuuaagucucuguucggaggcaugucgugguuuagccagauccuuauugguacauugcugguuuggcucgggcugaauaccaaaaacggauccaucucacuuacaugccuggccuugggcggugugaugauuuuccucaguacugcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11259 - RNA, 2320 nt, Artificial Sequence
  ZIKV (strain NatalRGN) prME-short variant mRNA Design 1 opt
gggagaaagcuuaccaugggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacaugugcgaugccacgaugaguuacgaguguccuauguuagacgaagggguggagccagaugacguagauugcugguguaacaccacaagcacuuggguggucuauggaaccugccaucacaaaaagggcgaagcucguagauccaggcgggcagugacacugccgucucauucgacccgcaaacuacagacuagaucacagacauggcucgagagcagggaguacaccaagcaccugauccggguugaaaauuggauuuuucgcaaccccggcuucgcccuugcugccgcggcaaucgccuggcuguuggggaguuccacgucucagaaggugauauaucucgucaugauccugcugauugcuccugccuacagcauccgauguauuggaguguccaauagagacuuuguagaggguaugucaggcgggacuuggguugaugugguccucgaacauggaggcugcgugaccgugauggcacaagacaaaccaacagucgauaucgaguuaguuacuaccacagugaguaacauggcugagguaaggagcuacuguuaugaagccucuauauccgacauggcgucagauagccggugccccacccagggugaggccuaccuggacaagcagagugacacgcaguauguguguaaacguacucuugucgaucgcggguggggaaauggcugcggcuuguucgggaagggaucucuggugacaugcgcaaaauuugcuuguuccaagaagaugaccgguaaaagcauucaaccugaaaaccuagaguacagaaucaugcucucgguucacggcucucagcacuccgggaugauugugaaugacacuggacaugaaacagaugagaacagggccaaggucgagaucaccccaaauucaccccgggcugaagccacgcugggcgguuucgggagucuuggccuggacugcgagccucgaaccggauuggauuuuagcgaccucuauuaccugacaaugaacaauaaacacugguuagugcauaaggaaugguuccacgauaucccacugccguggcacgcaggcgccgacacugggacaccccauuggaacaacaaagaggcucucguagaauuuaaggaugcgcacgcaaaacgccagaccguugugguccuuggaucccaggagggugccgugcauacugcucuggccggcgcauuggaggccgaaauggacggggcuaagggaagacuaucuagcggccaccugaaguguaggcucaaaauggauaagcugcggcuuaaaggugucucauauagucugugcaccgccgcauucacauuuaccaagauuccugcggagacuuugcaugggacggugacaguugaagugcaauacgcuggcaccgacggaccauguaaaguacccgcccagauggcagucgacaugcagacucucaccccugugggccgccugauaacagccaauccaguuaucaccgaguccacugaaaacagcaagaugauguuagagcuggaucccccguucggggacucuuacauugugaucggagucggugagaagaaaauaacacaccacuggcauagaucaggcaguacgauugggaaggcuuuugaagccaccgugaggggagcaaaacguauggcuguacuaggcgauacugccugggacuucgguagcguugggggcgcgcucaauucccugggaaagggcauccaccaaaucuucggggccgcuuuuaaaucucuuuucggaggcaugucgugguuuagccagauuuugaucgguacacugcucauguggcuggggcuuaacaccaagaauggauccauuucacugaugugcuuggcacucggcggugugcugauauucuuaaguacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11260 - RNA, 2293 nt, Artificial Sequence
  ZIKV (strain ZikaSPH2015) prME-short variant mRNA Design 1 opt
gggagaaagcuuaccaugaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacaugugcgaugccacgaugaguuacgaguguccuauguuagacgaaggaguggagccagaugacguagauugcugguguaauaccacaagcacuuggguggucuaugguaccugccaucacaaaaagggcgaagcucgccgaucccguagagcagugacacugccgucucauucgaccaggaaacuacaaacucggucacagacauggcucgagagccgcgaguacaccaagcaccugaucagaguugaaaacuggauuuuuaggaaucccggguucgcccuugcugccgcggcaaucgccuggcuguugggaaguuccacgucucagaaagugauauaucucgucaugauccugcugauugcuccugccuacagcauccgguguauuggcguguccaaccgcgacuuuguagagggcaugucagggggaacuuggguugauaucgugcucgaacaugguggcugcgucaccgugauggcacaggacaagccaacaguggauauagaguuagucacuaccacaguuaguaauauggcugaggugcgaagcuacuguuaugaagccucuauuuccgacauggcgucagauagcagaugccccacccaaggggaggccuaccuggacaagcagagugacacgcaguauguauguaaaaggacucuuguggaucggggauggggcaacgguugcggguuguucggaaagggcucucuggucacaugcgcaaaauuugcuuguuccaagaaaaugaccggcaagagcauccagccugaaaaucuagaguaccguauuaugcucucggugcacgggucucaacacuccggaaugaucguuaacgacacuggucaugaaacagaugagaaucgcgccaagguggagaucaccccaaacucacccagagcugaagccacgcugggcggguucggaagucuuggccuggacugcgagccuaggaccgguuuggauuuuagcgaccucuauuaccugacaaugaauaacaaacacugguuaguccauaaggaaugguuccacgauauuccacugccguggcacgcaggggccgacacuggcacaccccauuggaauaacaaagaggcucucguggaauuuaaggaugcgcacgcaaaacggcagaccguaguugugcuuggaucccaggagggcgccguccauacugcucuggccggggcauuggaggccgaaauggacggagcuaagggucgacuaucuagcggccaccugaaaugucgccucaagauggauaagcugagacuuaaaggggugucauauagucugugcaccgccgcauucacauuuaccaagauaccugcggagacuuugcauggaacggucacaguggaaguucaguacgcuggcaccgacgguccauguaaagugcccgcccaaauggcaguagacaugcagacucucaccccugucgggaggcugaucacagccaacccagugauuaccgaguccacugaaaauagcaagaugauguuagagcuggaucccccguucggcgacucuuacaucguuauaggagugggcgagaaaaagauuacacaccacuggcaucggucagggaguacgaucggaaaggcuuuugaagccaccguccgcggugcaaaaagaauggcugugcuaggcgauacugccugggacuucgggagcguaggaggcgcgcucaacucccuggguaaggggauccaccagauuuucggcgccgcuuuuaaaucucuuuucggaggcaugucgugguuuagccaaaucuugauugggacacugcucauguggcugggacuuaauaccaagaacggcuccauaucacugaugugcuuggcacucgguggggugcugaucuucuuaaguacagccguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11261 - RNA, 2293 nt, Artificial Sequence
  ZIKV (isolate Z1106033) prME-short variant mRNA Design 1 opt
gggagaaagcuuaccaugaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacacgugcgaugccaccaugaguuacgaguguccuauguuagacgaaggaguggagccagaugacguagauugcugguguaauacaacuagcaccuggguggucuauggcacaugccaucacaaaaagggugaagcucgccgaucccguagagcagugacccugccgucucauucgacuaggaaacuacaaacacggucacagaccuggcucgagagccgcgaguacacgaagcaccugaucagaguugaaaacuggauuuuuaggaaucccggguucgcccuugcugccgcggcaaucgccuggcuguugggaaguuccacuucucagaaagugauauaucucgucaugauccugcugauugcuccugccuacagcauccgguguauuggcguguccaaccgcgacuuuguagagggcaugucagggggaaccuggguugaugugguccucgaacaugguggcugcgugacagugauggcacaggacaagccaacugucgauaucgaguuaguuaccacaaccgugaguaauauggcugagguacgaagcuacuguuaugaagccucuauauccgacauggcgucagauagcagaugccccacgcaaggggaggccuaccuggacaagcagagugacacucaguauguguguaaaaggacacuugucgaucggggauggggcaacgguugcggguuguucggaaagggcucucuggugaccugcgcaaaauuugcuuguuccaagaaaaugacuggcaagagcauucagccugaaaaucuagaguaccguaucaugcucucgguucacgggucucaacacuccggaaugauugugaacgacacaggucaugaaaccgaugagaaucgcgccaaggucgagaucacgccaaacucacccagagcugaagccacccugggcggguucggaagucuuggccuggacugcgagccuaggacagguuuggauuuuagcgaccucuauuaccugacuaugaauaacaaacacugguuagugcauaaggaaugguuccacgauaucccacugccguggcacgcaggggccgacaccggcacaccccauuggaauaacaaagaggcucucguagaauuuaaggaugcgcacgcaaaacggcagacuguugugguccuuggaucccaggagggcgccgugcauaccgcucuggccggggcauuggaggccgaaauggacggagcuaagggucgacuaucuagcggccaccugaaaugucgccucaagauggauaagcugagacuuaaaggggucucauauagucugugcacagccgcauucaccuuuacuaagauuccugcggagacguugcauggaacagugaccguugaagugcaguacgcuggcacugacgguccauguaaaguacccgcccaaauggcagucgacaugcagacccucacaccuguggggaggcugauaaccgccaacccaguuaucacugaguccacagaaaauagcaagaugauguuagagcuggaucccccguucggcgacucuuacauugugaucggagucggcgagaaaaagauaacgcaccacuggcaucggucagggaguaccauuggaaaggcuuuugaagccacugugcgcggugcaaaaagaauggcuguacuaggcgauacagccugggacuucgggagcgugggaggcgcgcucaacucccuggguaaggggauccaccagaucuucggcgccgcuuuuaaaucucuuuucggaggcaugucgugguuuagccaaauuuugaucgggacccugcucauguggcugggacuuaaugcaaagaacggcuccauuucacugaugugcuuggcccucggugggguucugauauucuuaaguacagcugucucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11262 - RNA, 2281 nt, Artificial Sequence
  ZIKV (strain MR 766) prME-short variant mRNA Design 1 opt
gggagaaagcuuaccaugaacgagggcagcaucauguggcuggccucccucgcuguggucauugcaugcgccggggcgauaaccagaaggggaucugcuuacuauauguaccuugaccggucagaugccgguaaggcaaucaguuucgccacaacucugggcguuaauaaaugucacgugcagauuauggacuuggggcauaugugcgaugcuacgaugagcuaugaaugucccauguuagacgagggaguagaaccugaugacguggauugcugguguaacaccacauccacuugggucguguacgguaccugccaccauaagaaaggcgaggcacgccgaucucguagagccguuacacugccaucgcacucaaccaggaagcuacaaacucggagccagacauggcucgaaagucgcgaguauaccaaacaucugaucaagguggagaauuggauuuuuagaaacccgggguucgcucuugucgccguggcgaucgcauggcuguugggauccucuacgagccagaagguaauauaccucguuaugauccugcugauugcccccgcuuauuccaucagguguauuggcgugucaaaucgggacuuugucgaaggcaugagugggggaacuuggguggaugugguccucgagcacgguggcugcguuaccgugauggcccaggacaaaccuacaguagauaucgaauuagugacuaccacagucagcaacauggcagaggugcgcucuuacuguuacgaggcuuccauaucagacauggccagcgauagucgaugcccaacccaaggggaagcguaucuggacaagcagucugacacgcaguacguuuguaaaagaacucuuguggauaggggauggggcaaugguugcggguuguucggaaagggcucccuggucacaugcgccaaauuuaccuguagcaagaagaugacuggcaaaucgauucagcccgagaaccuagaauaucggaucaugcucucugugcacgggucccaacauucaggaaugauugguuacgagacagacgaagaucgugcaaagguagagguuaccccuaauaguccacgcgcugaggccacgcugggcggguucggaagccuuggccuggacugcgaacccagaaccgguuuggauuuuuccgaccucuauuaccugacaaugaacaauaaacacugguuagugcauaaggagugguuccacgauaucccucugccauggcacgcuggggccgacacuggcaccccgcauuggaacaauaaagaagcacucgucgaguuuaaggaugcccacgcuaaaaggcagacaguggucgugcuuggaucucaggaaggcgcgguucauacugcacuggccggggcuuuggaggccgagauggacggagcaaagggucggcuauucagcggccaccugaagugucgacucaaaauggauaagcugcgccuuaaaggggugucauauagucugugcaccgccgcuuuuacauucaccaagguacccgccgaaacuuugcauggaacggucacaguggagguucaguacgcaggcaccgacgguccuuguaaaaucccagugcaaauggcggucgacaugcagacucucacccccguggggagacugauuacagcuaacccuguaauaaccgaauccacugagaauagcaagaugauguuagaacuggauccacccuuuggcgacucuuacaucgugauuggaguuggcgauaagaaaaucacacaccacuggcauaggucagggaguacgauaggaaaggccuucgaggcaaccguccggggugccaaacgcauggcugugcuaggcgacacugccugggauuucgggagcgugggaggcgucuuuaacucccucgguaaggggauucaccagaucuucggcgcagcuuuuaaaucucuguucggaggcaugucgugguuuagccaaauccuuauugggacauugcugguuuggcucggacugaacaccaagaauggcuccaucucacuuacaugccuggccuuggguggggugaugauuuuccucaguacugcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11263 - RNA, 2293 nt, Artificial Sequence
  ZIKV (strain NatalRGN) prME-short variant mRNA Design 1 opt
gggagaaagcuuaccaugaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacaugugcgaugccacgaugaguuacgaguguccuauguuagacgaaggaguggagccagaugacguagauugcugguguaauaccacaagcacuuggguggucuaugguaccugccaucacaaaaagggcgaagcucgccgaucccguagagcagugacacugccgucucauucgaccaggaaacuacaaacucggucacagacauggcucgagagccgcgaguacaccaagcaccugaucagaguugaaaacuggauuuuuaggaaucccggguucgcccuugcugccgcggcaaucgccuggcuguugggaaguuccacgucucagaaagugauauaucucgucaugauccugcugauugcuccugccuacagcauccgguguauuggcguguccaaccgcgacuuuguagagggcaugucagggggaacuuggguugaugugguccucgaacaugguggcugcgugaccgugauggcacaggacaagccaacagucgauaucgaguuaguuacuaccacagugaguaauauggcugagguacgaagcuacuguuaugaagccucuauauccgacauggcgucagauagcagaugccccacccaaggggaggccuaccuggacaagcagagugacacgcaguauguguguaaaaggacucuugucgaucggggauggggcaacgguugcggguuguucggaaagggcucucuggugacaugcgcaaaauuugcuuguuccaagaaaaugaccggcaagagcauucagccugaaaaucuagaguaccguaucaugcucucgguucacgggucucaacacuccggaaugauugugaacgacacuggucaugaaacagaugagaaucgcgccaaggucgagaucaccccaaacucacccagagcugaagccacgcugggcggguucggaagucuuggccuggacugcgagccuaggaccgguuuggauuuuagcgaccucuauuaccugacaaugaauaacaaacacugguuagugcauaaggaaugguuccacgauaucccacugccguggcacgcaggggccgacacuggcacaccccauuggaauaacaaagaggcucucguagaauuuaaggaugcgcacgcaaaacggcagaccguugugguccuuggaucccaggagggcgccgugcauacugcucuggccggggcauuggaggccgaaauggacggagcuaagggucgacuaucuagcggccaccugaaaugucgccucaagauggauaagcugagacuuaaaggggucucauauagucugugcaccgccgcauucacauuuaccaagauuccugcggagacuuugcauggaacggugacaguugaagugcaguacgcuggcaccgacgguccauguaaaguacccgcccaaauggcagucgacaugcagacucucaccccuguggggaggcugauaacagccaacccaguuaucaccgaguccacugaaaauagcaagaugauguuagagcuggaucccccguucggcgacucuuacauugugaucggagucggcgagaaaaagauaacacaccacuggcaucggucagggaguacgauuggaaaggcuuuugaagccaccgugcgcggugcaaaaagaauggcuguacuaggcgauacugccugggacuucgggagcgugggaggcgcgcucaacucccuggguaaggggauccaccagaucuucggcgccgcuuuuaaaucucuuuucggaggcaugucgugguuuagccaaauuuugaucgggacacugcucauguggcugggacuuaauaccaagaacggcuccauuucacugaugugcuuggcacucggugggguucugauauucuuaaguacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11264 - RNA, 2320 nt, Artificial Sequence
  ZIKV (strain ZikaSPH2015) prME-short variant mRNA Design 1 opt
gggagaaagcuuaccaugggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacaugugcgaugccacgaugaguuacgaguguccuauguuagacgaagggguggagccagaugacguagauugcugguguaacaccacaagcacuuggguggucuauggaaccugccaucacaaaaagggcgaagcucguagauccaggcgggcagugacacugccgucucauucgacccgcaaacuacagacuagaucacagacauggcucgagagcagggaguacaccaagcaccugauccggguugaaaauuggauuuuucgcaaccccggcuucgcccuugcugccgcggcaaucgccuggcuguuggggaguuccacgucucagaaggugauauaucucgucaugauccugcugauugcuccugccuacagcauccgauguauuggaguguccaauagagacuuuguagaggguaugucaggcgggacuuggguugauaucgugcucgaacauggaggcugcgucaccgugauggcacaagacaaaccaacaguggauauagaguuagucacuaccacaguuaguaacauggcugaggugaggagcuacuguuaugaagccucuauuuccgacauggcgucagauagccggugccccacccagggugaggccuaccuggacaagcagagugacacgcaguauguauguaaacguacucuuguggaucgcggguggggaaauggcugcggcuuguucgggaagggaucucuggucacaugcgcaaaauuugcuuguuccaagaagaugaccgguaaaagcauccaaccugaaaaccuagaguacagaauuaugcucucggugcacggcucucagcacuccgggaugaucguuaaugacacuggacaugaaacagaugagaacagggccaagguggagaucaccccaaauucaccccgggcugaagccacgcugggcgguuucgggagucuuggccuggacugcgagccucgaaccggauuggauuuuagcgaccucuauuaccugacaaugaacaauaaacacugguuaguccauaaggaaugguuccacgauauuccacugccguggcacgcaggcgccgacacugggacaccccauuggaacaacaaagaggcucucguggaauuuaaggaugcgcacgcaaaacgccagaccguaguugugcuuggaucccaggagggugccguccauacugcucuggccggcgcauuggaggccgaaauggacggggcuaagggaagacuaucuagcggccaccugaaguguaggcucaaaauggauaagcugcggcuuaaaggugugucauauagucugugcaccgccgcauucacauuuaccaagauaccugcggagacuuugcaugggacggucacaguggaaguucaauacgcuggcaccgacggaccauguaaagugcccgcccagauggcaguagacaugcagacucucaccccugucggccgccugaucacagccaauccagugauuaccgaguccacugaaaacagcaagaugauguuagagcuggaucccccguucggggacucuuacaucguuauaggagugggugagaagaaaauuacacaccacuggcauagaucaggcaguacgcuagggaaggcuuuuagcaccacucucaaaggagcccaaaggcuggcagcucuuggcgauacagccugggacuucgguuccaucgggggcgucuucaauucuaucggacgugcggugcaccagguauuuggcggggccuuccggaccuuguuuggaggcaugucguggauuacacagggucugaugggggcucuccugcuuuggaugggagugaacgcacgagauagaagcaucgcccuggcuuucuuggccacuggcgguguucucgucuuucuggcaaccaaugugcaugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11265 - RNA, 2320 nt, Artificial Sequence
  ZIKV (isolate Z1106033) prME-short variant mRNA Design 1 opt
gggagaaagcuuaccaugggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacacgugcgaugccaccaugaguuacgaguguccuauguuagacgaagggguggagccagaugacguagauugcugguguaacacaacuagcaccuggguggucuauggaacaugccaucacaaaaagggcgaagcucguagauccaggcgggcagugacccugccgucucauucgacucgcaaacuacagacaagaucacagaccuggcucgagagcagggaguacacgaagcaccugauccggguugaaaauuggauuuuucgcaaccccggcuucgcccuugcugccgcggcaaucgccuggcuguuggggaguuccacuucucagaaggugauauaucucgucaugauccugcugauugcuccugccuacagcauccgauguauuggaguguccaauagagacuuuguagaggguaugucaggcgggaccuggguugaugugguccucgaacauggaggcugcgugacagugauggcacaagacaaaccaacugucgauaucgaguuaguuaccacaaccgugaguaacauggcugagguaaggagcuacuguuaugaagccucuauauccgacauggcgucagauagccggugccccacgcagggugaggccuaccuggacaagcagagugacacucaguauguguguaaacguacacuugucgaucgcggguggggaaauggcugcggcuuguucgggaagggaucucuggugaccugcgcaaaauuugcuuguuccaagaagaugacugguaaaagcauucaaccugaaaaccuagaguacagaaucaugcucucgguucacggcucucagcacuccgggaugauugugaaugacacaggacaugaaaccgaugagaacagggccaaggucgagaucacgccaaauucaccccgggcugaagccacccugggcgguuucgggagucuuggccuggacugcgagccucgaacaggauuggauuuuagcgaccucuauuaccugacuaugaacaauaaacacugguuagugcauaaggaaugguuccacgauaucccacugccguggcacgcaggcgccgacaccgggacaccccauuggaacaacaaagaggcucucguagaauuuaaggaugcgcacgcaaaacgccagacuguugugguccuuggaucccaggagggugccgugcauaccgcucuggccggcgcauuggaggccgaaauggacggggcuaagggaagacuaucuagcggccaccugaaguguaggcucaaaauggauaagcugcggcuuaaaggugucucauauagucugugcacagccgcauucaccuuuacuaagauuccugcggagacguugcaugggacagugaccguugaagugcaauacgcuggcacugacggaccauguaaaguacccgcccagauggcagucgacaugcagacccucacaccugugggccgccugauaaccgccaauccaguuaucacugaguccacagaaaacagcaagaugauguuagagcuggaucccccguucggggacucuuacauugugaucggagucggugagaagaaaauaacgcaccacuggcauagaucaggcaguacccuagggaaggcuuuuagcacuacacucaaaggagcccaaaggcuggcagcucuuggcgauaccgccugggacuucgguuccauugggggcguguucaauucuaucggacgugcgguacaccagguguuuggcggggccuuccggacauuguuuggaggcaugucguggaucacucagggucugaugggggcucuccugcuuuggaugggaguuaacgcacgagauagaagcauugcccuggcuuucuuggccaccggcgguguccucguguuucuggcaacgaaugugcaugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11266 - RNA, 2308 nt, Artificial Sequence
  ZIKV (strain MR 766) prME-short variant mRNA Design 1 opt
gggagaaagcuuaccaugggcagaaagcagaacaaaaggggagggaaugaggguagcaucauguggcuggccucccucgcuguggucauugcaugcgccggcgcgauaacccggcgcgggucugcuuacuauauguaccuugaccgaucagaugccggaaaggcaaucaguuucgccacaacucugggcguuaacaaaugucacgugcaaauuauggacuugggucauaugugcgaugcuacgaugagcuaugaaugucccauguuagacgaggggguagaaccugaugacguggauugcugguguaauaccacauccacuugggucguguacggaaccugccaccauaagaaaggcgaggcacguagaucuaggcgggccguuacacugccaucgcacucaacccgcaagcuacagacuagaagccagacauggcucgaaaguagggaguauaccaagcaucugaucaaaguggagaacuggauuuuucggaauccgggcuucgcucuugucgccguggcgaucgcauggcuguugggguccucuacgagccagaagguaauauaccucguuaugauccugcugauugcccccgcuuauuccauccgcuguauuggagugucaaaccgagacuuugucgaagguaugaguggcgggacuuggguggaugugguccucgagcacggaggcugcguuaccgugauggcccaagacaaaccuacaguagauaucgaauuagugacuaccacagucagcaauauggcagaggugagaucuuacuguuacgaggcuuccauaucagacauggccagcgauaguaggugcccaacccagggugaagcguaucuggacaagcagucugacacgcaguacguuuguaaacggacucuuguggaucguggguggggaaacggcugcggcuuguucgggaagggaucccuggucacaugcgccaaguuuaccuguagcaaaaagaugacugguaaaucgauucaacccgagaaucuagaauaucgcaucaugcucucugugcacggcucccagcauucagggaugauuggauacgagacagacgaagauagagcaaagguagagguuaccccuaacaguccaagggcugaggccacgcugggcgguuucgggagccuuggccuggacugcgaaccccggaccggauuggauuuuuccgaccucuauuaccugacaaugaauaacaaacacugguuagugcauaaggagugguuccacgauaucccucugccauggcacgcuggcgccgacacugggaccccgcauuggaauaacaaagaagcacucgucgaguuuaaggaugcccacgcuaagcgacagacaguggucgugcuuggaucucaggaaggugcgguucauacugcacuggccggcgcuuuggaggccgagauggacggggcaaaaggacgccuauucagcggccaccugaaguguagacucaaaauggauaagcugaggcuuaaaggugugucauauagucugugcaccgccgcuuuuacauucaccaagguacccgccgaaacuuugcaugggacggucacaguggagguucaauacgcaggcaccgacggaccuuguaagaucccagugcagauggcggucgacaugcagacucucacccccgugggccggcugauuacagcuaauccuguaauaaccgaauccacugagaacagcaaaaugauguuagaacuggauccacccuuuggggacucuuacaucgugauuggaguuggugauaagaaaaucacacaccacuggcaucgcucaggcaguacgcuagggaaggccuucagcaccacucucaaaggagcacaaagacuggccgcucuuggcgacacagccugggauuucgguuccauagggggcgucuuuaacucuauuggaagggcagugcaccagguguucggcggggcuuuucguaccuuguucggaggcaugucguggaucacacagggucugaugggggcccuccugcuuuggaugggagucaaugcgcgggaccgaagcaucgcccuggcauuuuuggcuacuggcgguguucucguguuccuggccaccaacgugcaugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11267 - RNA, 2320 nt, Artificial Sequence
  ZIKV (strain NatalRGN) prME-short variant mRNA Design 1 opt
gggagaaagcuuaccaugggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacaugugcgaugccacgaugaguuacgaguguccuauguuagacgaagggguggagccagaugacguagauugcugguguaacaccacaagcacuuggguggucuauggaaccugccaucacaaaaagggcgaagcucguagauccaggcgggcagugacacugccgucucauucgacccgcaaacuacagacuagaucacagacauggcucgagagcagggaguacaccaagcaccugauccggguugaaaauuggauuuuucgcaaccccggcuucgcccuugcugccgcggcaaucgccuggcuguuggggaguuccacgucucagaaggugauauaucucgucaugauccugcugauugcuccugccuacagcauccgauguauuggaguguccaauagagacuuuguagaggguaugucaggcgggacuuggguugaugugguccucgaacauggaggcugcgugaccgugauggcacaagacaaaccaacagucgauaucgaguuaguuacuaccacagugaguaacauggcugagguaaggagcuacuguuaugaagccucuauauccgacauggcgucagauagccggugccccacccagggugaggccuaccuggacaagcagagugacacgcaguauguguguaaacguacucuugucgaucgcggguggggaaauggcugcggcuuguucgggaagggaucucuggugacaugcgcaaaauuugcuuguuccaagaagaugaccgguaaaagcauucaaccugaaaaccuagaguacagaaucaugcucucgguucacggcucucagcacuccgggaugauugugaaugacacuggacaugaaacagaugagaacagggccaaggucgagaucaccccaaauucaccccgggcugaagccacgcugggcgguuucgggagucuuggccuggacugcgagccucgaaccggauuggauuuuagcgaccucuauuaccugacaaugaacaauaaacacugguuagugcauaaggaaugguuccacgauaucccacugccguggcacgcaggcgccgacacugggacaccccauuggaacaacaaagaggcucucguagaauuuaaggaugcgcacgcaaaacgccagaccguugugguccuuggaucccaggagggugccgugcauacugcucuggccggcgcauuggaggccgaaauggacggggcuaagggaagacuaucuagcggccaccugaaguguaggcucaaaauggauaagcugcggcuuaaaggugucucauauagucugugcaccgccgcauucacauuuaccaagauuccugcggagacuuugcaugggacggugacaguugaagugcaauacgcuggcaccgacggaccauguaaaguacccgcccagauggcagucgacaugcagacucucaccccugugggccgccugauaacagccaauccaguuaucaccgaguccacugaaaacagcaagaugauguuagagcuggaucccccguucggggacucuuacauugugaucggagucggugagaagaaaauaacacaccacuggcauagaucaggcaguacgcuagggaaggcuuuuagcaccacucucaaaggagcccaaaggcuggcagcucuuggcgauacagccugggacuucgguuccauugggggcguguucaauucuaucggacgugcgguacaccagguguuuggcggggccuuccggaccuuguuuggaggcaugucguggaucacacagggucugaugggggcucuccugcuuuggaugggaguuaacgcacgagauagaagcauugcccuggcuuucuuggccacuggcgguguccucguguuucuggcaaccaaugugcaugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11268 - RNA, 2293 nt, Artificial Sequence
  ZIKV (strain ZikaSPH2015) prME-short variant mRNA Design 1 opt
gggagaaagcuuaccaugaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacaugugcgaugccacgaugaguuacgaguguccuauguuagacgaaggaguggagccagaugacguagauugcugguguaauaccacaagcacuuggguggucuaugguaccugccaucacaaaaagggcgaagcucgccgaucccguagagcagugacacugccgucucauucgaccaggaaacuacaaacucggucacagacauggcucgagagccgcgaguacaccaagcaccugaucagaguugaaaacuggauuuuuaggaaucccggguucgcccuugcugccgcggcaaucgccuggcuguugggaaguuccacgucucagaaagugauauaucucgucaugauccugcugauugcuccugccuacagcauccgguguauuggcguguccaaccgcgacuuuguagagggcaugucagggggaacuuggguugauaucgugcucgaacaugguggcugcgucaccgugauggcacaggacaagccaacaguggauauagaguuagucacuaccacaguuaguaauauggcugaggugcgaagcuacuguuaugaagccucuauuuccgacauggcgucagauagcagaugccccacccaaggggaggccuaccuggacaagcagagugacacgcaguauguauguaaaaggacucuuguggaucggggauggggcaacgguugcggguuguucggaaagggcucucuggucacaugcgcaaaauuugcuuguuccaagaaaaugaccggcaagagcauccagccugaaaaucuagaguaccguauuaugcucucggugcacgggucucaacacuccggaaugaucguuaacgacacuggucaugaaacagaugagaaucgcgccaagguggagaucaccccaaacucacccagagcugaagccacgcugggcggguucggaagucuuggccuggacugcgagccuaggaccgguuuggauuuuagcgaccucuauuaccugacaaugaauaacaaacacugguuaguccauaaggaaugguuccacgauauuccacugccguggcacgcaggggccgacacuggcacaccccauuggaauaacaaagaggcucucguggaauuuaaggaugcgcacgcaaaacggcagaccguaguugugcuuggaucccaggagggcgccguccauacugcucuggccggggcauuggaggccgaaauggacggagcuaagggucgacuaucuagcggccaccugaaaugucgccucaagauggauaagcugagacuuaaaggggugucauauagucugugcaccgccgcauucacauuuaccaagauaccugcggagacuuugcauggaacggucacaguggaaguucaguacgcuggcaccgacgguccauguaaagugcccgcccaaauggcaguagacaugcagacucucaccccugucgggaggcugaucacagccaacccagugauuaccgaguccacugaaaauagcaagaugauguuagagcuggaucccccguucggcgacucuuacaucguuauaggagugggcgagaaaaagauuacacaccacuggcaucggucagggaguacgcuaggaaaggcuuuuagcaccacucucaaaggugcccagcgccuggcagcucuuggcgauacagccugggacuucggguccaucggaggcgucuucaacucuaucgguagagcggugcaccaaguauuugggggcgccuucaggaccuuguuuggaggcaugucguggauuacacaggggcugaugggagcucuccugcuuuggaugggcgugaaugcacgugaucggagcaucgcccuggcuuucuuggccacuggugggguucucgucuuucuggcaaccaacgugcaugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11269 - RNA, 2293 nt, Artificial Sequence
  ZIKV (isolate Z1106033) prME-short variant mRNA Design 1 opt
gggagaaagcuuaccaugaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacacgugcgaugccaccaugaguuacgaguguccuauguuagacgaaggaguggagccagaugacguagauugcugguguaauacaacuagcaccuggguggucuauggcacaugccaucacaaaaagggugaagcucgccgaucccguagagcagugacccugccgucucauucgacuaggaaacuacaaacacggucacagaccuggcucgagagccgcgaguacacgaagcaccugaucagaguugaaaacuggauuuuuaggaaucccggguucgcccuugcugccgcggcaaucgccuggcuguugggaaguuccacuucucagaaagugauauaucucgucaugauccugcugauugcuccugccuacagcauccgguguauuggcguguccaaccgcgacuuuguagagggcaugucagggggaaccuggguugaugugguccucgaacaugguggcugcgugacagugauggcacaggacaagccaacugucgauaucgaguuaguuaccacaaccgugaguaauauggcugagguacgaagcuacuguuaugaagccucuauauccgacauggcgucagauagcagaugccccacgcaaggggaggccuaccuggacaagcagagugacacucaguauguguguaaaaggacacuugucgaucggggauggggcaacgguugcggguuguucggaaagggcucucuggugaccugcgcaaaauuugcuuguuccaagaaaaugacuggcaagagcauucagccugaaaaucuagaguaccguaucaugcucucgguucacgggucucaacacuccggaaugauugugaacgacacaggucaugaaaccgaugagaaucgcgccaaggucgagaucacgccaaacucacccagagcugaagccacccugggcggguucggaagucuuggccuggacugcgagccuaggacagguuuggauuuuagcgaccucuauuaccugacuaugaauaacaaacacugguuagugcauaaggaaugguuccacgauaucccacugccguggcacgcaggggccgacaccggcacaccccauuggaauaacaaagaggcucucguagaauuuaaggaugcgcacgcaaaacggcagacuguugugguccuuggaucccaggagggcgccgugcauaccgcucuggccggggcauuggaggccgaaauggacggagcuaagggucgacuaucuagcggccaccugaaaugucgccucaagauggauaagcugagacuuaaaggggucucauauagucugugcacagccgcauucaccuuuacuaagauuccugcggagacguugcauggaacagugaccguugaagugcaguacgcuggcacugacgguccauguaaaguacccgcccaaauggcagucgacaugcagacccucacaccuguggggaggcugauaaccgccaacccaguuaucacugaguccacagaaaauagcaagaugauguuagagcuggaucccccguucggcgacucuuacauugugaucggagucggcgagaaaaagauaacgcaccacuggcaucggucagggaguacccuaggaaaggcuuuuagcacuacacucaaaggugcccagcgccuggcagcucuuggcgauaccgccugggacuucggguccauuggaggcguguucaacucuaucgguagagcgguacaccaaguguuugggggcgccuucaggacauuguuuggaggcaugucguggaucacucaggggcugaugggagcucuccugcuuuggaugggcguuaaugcacgugaucggagcauugcccuggcuuucuuggccaccggugggguccucguguuucuggcaacgaacgugcaugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11270 - RNA, 2281 nt, Artificial Sequence
  ZIKV (strain MR 766) prME-short variant mRNA Design 1 opt
gggagaaagcuuaccaugaacgagggcagcaucauguggcuggccucccucgcuguggucauugcaugcgccggggcgauaaccagaaggggaucugcuuacuauauguaccuugaccggucagaugccgguaaggcaaucaguuucgccacaacucugggcguuaauaaaugucacgugcagauuauggacuuggggcauaugugcgaugcuacgaugagcuaugaaugucccauguuagacgagggaguagaaccugaugacguggauugcugguguaacaccacauccacuugggucguguacgguaccugccaccauaagaaaggcgaggcacgccgaucucguagagccguuacacugccaucgcacucaaccaggaagcuacaaacucggagccagacauggcucgaaagucgcgaguauaccaaacaucugaucaagguggagaauuggauuuuuagaaacccgggguucgcucuugucgccguggcgaucgcauggcuguugggauccucuacgagccagaagguaauauaccucguuaugauccugcugauugcccccgcuuauuccaucagguguauuggcgugucaaaucgggacuuugucgaaggcaugagugggggaacuuggguggaugugguccucgagcacgguggcugcguuaccgugauggcccaggacaaaccuacaguagauaucgaauuagugacuaccacagucagcaacauggcagaggugcgcucuuacuguuacgaggcuuccauaucagacauggccagcgauagucgaugcccaacccaaggggaagcguaucuggacaagcagucugacacgcaguacguuuguaaaagaacucuuguggauaggggauggggcaaugguugcggguuguucggaaagggcucccuggucacaugcgccaaauuuaccuguagcaagaagaugacuggcaaaucgauucagcccgagaaccuagaauaucggaucaugcucucugugcacgggucccaacauucaggaaugauugguuacgagacagacgaagaucgugcaaagguagagguuaccccuaauaguccacgcgcugaggccacgcugggcggguucggaagccuuggccuggacugcgaacccagaaccgguuuggauuuuuccgaccucuauuaccugacaaugaacaauaaacacugguuagugcauaaggagugguuccacgauaucccucugccauggcacgcuggggccgacacuggcaccccgcauuggaacaauaaagaagcacucgucgaguuuaaggaugcccacgcuaaaaggcagacaguggucgugcuuggaucucaggaaggcgcgguucauacugcacuggccggggcuuuggaggccgagauggacggagcaaagggucggcuauucagcggccaccugaagugucgacucaaaauggauaagcugcgccuuaaaggggugucauauagucugugcaccgccgcuuuuacauucaccaagguacccgccgaaacuuugcauggaacggucacaguggagguucaguacgcaggcaccgacgguccuuguaaaaucccagugcaaauggcggucgacaugcagacucucacccccguggggagacugauuacagcuaacccuguaauaaccgaauccacugagaauagcaagaugauguuagaacuggauccacccuuuggcgacucuuacaucgugauuggaguuggcgauaagaaaaucacacaccacuggcauaggucagggaguacgcuaggaaaggccuucagcaccacucucaaaggugcacagcggcuggccgcucuuggcgacacagccugggauuucggguccauaggaggcgucuuuaacucuauuggucgcgcagugcaccaaguguucgggggcgcuuuuagaaccuuguucggaggcaugucguggaucacacaggggcugaugggagcccuccugcuuuggaugggcgucaacgcgagggaccguagcaucgcccuggcauuuuuggcuacuggugggguucucguguuccuggccaccaaugugcaugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11271 - RNA, 2293 nt, Artificial Sequence
  ZIKV (strain NatalRGN) prME-short variant mRNA Design 1 opt
gggagaaagcuuaccaugaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacaugugcgaugccacgaugaguuacgaguguccuauguuagacgaaggaguggagccagaugacguagauugcugguguaauaccacaagcacuuggguggucuaugguaccugccaucacaaaaagggcgaagcucgccgaucccguagagcagugacacugccgucucauucgaccaggaaacuacaaacucggucacagacauggcucgagagccgcgaguacaccaagcaccugaucagaguugaaaacuggauuuuuaggaaucccggguucgcccuugcugccgcggcaaucgccuggcuguugggaaguuccacgucucagaaagugauauaucucgucaugauccugcugauugcuccugccuacagcauccgguguauuggcguguccaaccgcgacuuuguagagggcaugucagggggaacuuggguugaugugguccucgaacaugguggcugcgugaccgugauggcacaggacaagccaacagucgauaucgaguuaguuacuaccacagugaguaauauggcugagguacgaagcuacuguuaugaagccucuauauccgacauggcgucagauagcagaugccccacccaaggggaggccuaccuggacaagcagagugacacgcaguauguguguaaaaggacucuugucgaucggggauggggcaacgguugcggguuguucggaaagggcucucuggugacaugcgcaaaauuugcuuguuccaagaaaaugaccggcaagagcauucagccugaaaaucuagaguaccguaucaugcucucgguucacgggucucaacacuccggaaugauugugaacgacacuggucaugaaacagaugagaaucgcgccaaggucgagaucaccccaaacucacccagagcugaagccacgcugggcggguucggaagucuuggccuggacugcgagccuaggaccgguuuggauuuuagcgaccucuauuaccugacaaugaauaacaaacacugguuagugcauaaggaaugguuccacgauaucccacugccguggcacgcaggggccgacacuggcacaccccauuggaauaacaaagaggcucucguagaauuuaaggaugcgcacgcaaaacggcagaccguugugguccuuggaucccaggagggcgccgugcauacugcucuggccggggcauuggaggccgaaauggacggagcuaagggucgacuaucuagcggccaccugaaaugucgccucaagauggauaagcugagacuuaaaggggucucauauagucugugcaccgccgcauucacauuuaccaagauuccugcggagacuuugcauggaacggugacaguugaagugcaguacgcuggcaccgacgguccauguaaaguacccgcccaaauggcagucgacaugcagacucucaccccuguggggaggcugauaacagccaacccaguuaucaccgaguccacugaaaauagcaagaugauguuagagcuggaucccccguucggcgacucuuacauugugaucggagucggcgagaaaaagauaacacaccacuggcaucggucagggaguacgcuaggaaaggcuuuuagcaccacucucaaaggugcccagcgccuggcagcucuuggcgauacagccugggacuucggguccauuggaggcguguucaacucuaucgguagagcgguacaccaaguguuugggggcgccuucaggaccuuguuuggaggcaugucguggaucacacaggggcugaugggagcucuccugcuuuggaugggcguuaaugcacgugaucggagcauugcccuggcuuucuuggccacuggugggguccucguguuucuggcaaccaacgugcaugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11272 - RNA, 2320 nt, Artificial Sequence; identical to SEQ ID NO: 11256
  ZIKV (strain ZikaSPH2015) ME variant mRNA Design 1 opt

SEQ ID NO: 11273 - RNA, 2320 nt, Artificial Sequence; identical to SEQ ID NO: 11257
  ZIKV (isolate Z1106033) ME variant mRNA Design 1 opt

SEQ ID NO: 11274 - RNA, 2308 nt, Artificial Sequence; identical to SEQ ID NO: 11258
  ZIKV (strain MR 766) ME variant mRNA Design 1 opt

SEQ ID NO: 11275 - RNA, 2320 nt, Artificial Sequence; identical to SEQ ID NO: 11259
  ZIKV (strain NatalRGN) ME variant mRNA Design 1 opt

SEQ ID NO: 11276 - RNA, 2293 nt, Artificial Sequence; identical to SEQ ID NO: 11260
  ZIKV (strain ZikaSPH2015) ME variant mRNA Design 1 opt

SEQ ID NO: 11277 - RNA, 2293 nt, Artificial Sequence; identical to SEQ ID NO: 11261
  ZIKV (isolate Z1106033) ME variant mRNA Design 1 opt

SEQ ID NO: 11278 - RNA, 2281 nt, Artificial Sequence; identical to SEQ ID NO: 11262
  ZIKV (strain MR 766) ME variant mRNA Design 1 opt

SEQ ID NO: 11279 - RNA, 2293 nt, Artificial Sequence; identical to SEQ ID NO: 11263
  ZIKV (strain NatalRGN) ME variant mRNA Design 1 opt

SEQ ID NO: 11280 - RNA, 2320 nt, Artificial Sequence
  ZIKV (strain ZikaSPH2015) prME-short variant mRNA Design 1 opt
gggagaaagcuuaccaugggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11281 - RNA, 2320 nt, Artificial Sequence
  ZIKV (isolate Z1106033) prME-short variant mRNA Design 1 opt
gggagaaagcuuaccaugggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11282 - RNA, 2308 nt, Artificial Sequence
  ZIKV (strain MR 766) prME-short variant mRNA Design 1 opt
gggagaaagcuuaccaugggcagaaagcagaacaagagaggcggcaacgagggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11283 - RNA, 2320 nt, Artificial Sequence
  ZIKV (strain NatalRGN) prME-short variant mRNA Design 1 opt
gggagaaagcuuaccaugggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11284 - RNA, 2293 nt, Artificial Sequence
  ZIKV (strain ZikaSPH2015) prME-short variant mRNA Design 1 opt
gggagaaagcuuaccaugaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11285 - RNA, 2293 nt, Artificial Sequence
  ZIKV (isolate Z1106033) prME-short variant mRNA Design 1 opt
gggagaaagcuuaccaugaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11286 - RNA, 2281 nt, Artificial Sequence
  ZIKV (strain MR 766) prME-short variant mRNA Design 1 opt
gggagaaagcuuaccaugaacgagggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11287 - RNA, 2293 nt, Artificial Sequence
  ZIKV (strain NatalRGN) prME-short variant mRNA Design 1 opt
gggagaaagcuuaccaugaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11288 - RNA, 2320 nt, Artificial Sequence
  ZIKV (strain ZikaSPH2015) prME-short variant mRNA Design 1 opt
gggagaaagcuuaccaugggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11289 - RNA, 2320 nt, Artificial Sequence
  ZIKV (isolate Z1106033) prME-short variant mRNA Design 1 opt
gggagaaagcuuaccaugggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11290 - RNA, 2308 nt, Artificial Sequence
  ZIKV (strain MR 766) prME-short variant mRNA Design 1 opt
gggagaaagcuuaccaugggcagaaagcagaacaagagaggcggcaacgagggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11291 - RNA, 2320 nt, Artificial Sequence
  ZIKV (strain NatalRGN) prME-short variant mRNA Design 1 opt
gggagaaagcuuaccaugggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11292 - RNA, 2293 nt, Artificial Sequence
  ZIKV (strain ZikaSPH2015) prME-short variant mRNA Design 1 opt
gggagaaagcuuaccaugaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11293 - RNA, 2293 nt, Artificial Sequence
  ZIKV (isolate Z1106033) prME-short variant mRNA Design 1 opt
gggagaaagcuuaccaugaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11294 - RNA, 2281 nt, Artificial Sequence
  ZIKV (strain MR 766) prME-short variant mRNA Design 1 opt
gggagaaagcuuaccaugaacgagggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11295 - RNA, 2293 nt, Artificial Sequence
  ZIKV (strain NatalRGN) prME-short variant mRNA Design 1 opt
gggagaaagcuuaccaugaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11296 - RNA, 2320 nt, Artificial Sequence; identical to SEQ ID NO: 11280
  ZIKV (strain ZikaSPH2015) ME variant mRNA Design 1 opt

SEQ ID NO: 11297 - RNA, 2320 nt, Artificial Sequence; identical to SEQ ID NO: 11281
  ZIKV (isolate Z1106033) ME variant mRNA Design 1 opt

SEQ ID NO: 11298 - RNA, 2308 nt, Artificial Sequence; identical to SEQ ID NO: 11282
  ZIKV (strain MR 766) ME variant mRNA Design 1 opt

SEQ ID NO: 11299 - RNA, 2320 nt, Artificial Sequence; identical to SEQ ID NO: 11283
  ZIKV (strain NatalRGN) ME variant mRNA Design 1 opt

SEQ ID NO: 11300 - RNA, 2293 nt, Artificial Sequence; identical to SEQ ID NO: 11284
  ZIKV (strain ZikaSPH2015) ME variant mRNA Design 1 opt

SEQ ID NO: 11301 - RNA, 2293 nt, Artificial Sequence; identical to SEQ ID NO: 11285
  ZIKV (isolate Z1106033) ME variant mRNA Design 1 opt

SEQ ID NO: 11302 - RNA, 2281 nt, Artificial Sequence; identical to SEQ ID NO: 11286
  ZIKV (strain MR 766) ME variant mRNA Design 1 opt

SEQ ID NO: 11303 - RNA, 2293 nt, Artificial Sequence; identical to SEQ ID NO: 11287
  ZIKV (strain NatalRGN) ME variant mRNA Design 1 opt

SEQ ID NO: 11304 - RNA, 2320 nt, Artificial Sequence
  ZIKV (strain ZikaSPH2015) prME-short variant mRNA Design 1 opt
gggagaaagcuuaccaugggcagaaagcagaacaaacggggcggaaaugagggcagcaucauguggcuggccucccucgcuguggucauugccugcgcgggggcuguuacccgcagaggaucugccuacuauauguaccuggaccggaacgaugccggcgaagcuaucagcuuccccacaacgcuugggaugaauaaguguuauauucaaaucauggaccugggacacaugugcgaugccaccauguccuacgaguguccuaugcucgacgaaggcguggagccggaugacguggauugcugguguaacacaaccucuacaugggucguguaugggaccugccaucacaaaaagggggaagcucgcagaagccggcgcgccguuacacugcccucccauucuaccagaaaacuucagacgcggagccagaccuggcuggagucccgcgaguacacaaagcaccucauuagaguggaaaauuggaucuuucggaacccuggauucgcgcuggccgcugccgcuaucgccuggcugcucggcagcucuaccucccagaaggucauuuaucuggugaugauccuucugauugcgcccgccuacagcauccgcuguauugggguuucuaauagagacuuuguggagggaauguccggcgggacaugggucgauaucgugcucgaacauggaggcugcgugaccgucauggcucaagacaaaccuacgguugauauugagcuggugacaaccacagugagcaacauggccgagguccggucuuacuguuaugaggcuuccaucagcgacauggccuccgauucucgcugccccacccagggcgaagccuaccuugacaagcagagcgacacccaguauguguguaaaagaacacugguugaucggggguggggaaauggcugcgggcuguucggaaagggcucccuggugacgugcgcuaaauuugcguguagcaagaagaugaccgggaaaucuauccaaccugaaaaccuggaguacagaauuaugcucuccguccacggaagccagcacucuggcaugaucgugaaugacacaggccaugaaaccgaugagaaccgcgccaagguugagauuacaccgaauagcccccgggcugaagccacccucgggggauucggcucccuugggcuggacugcgagccuagaacgggacucgauuuuucugaccuguauuaccuuacaaugaacaauaaacacuggcuggugcauaaggaaugguuccacgauaucccccucccuuggcacgccggcgcugacaccgggacaccccauuggaacaacaaagaggcccuggucgaauuuaaggaugcgcacgcuaaacgccagaccguggucgugcugggcagccaggagggagccguucauaccgcccucgcuggcgcccuggaggcugaaauggacggggccaagggacggcuuuccagcggccaccugaaguguagacucaaaauggauaagcugcgccuuaaaggggugucuuauucccugugcacagcggccuucacguuuaccaagauuccggcugagacacuccauggaaccgucacaguggaaguucaauacgccggcaccgacgggccuuguaaagugcccgcucagauggccgucgacaugcagacgcugaccccugugggccggcugaucacagcgaaucccgugaucaccgagagcacagaaaacucuaagaugaugcucgagcuggaucccccuuucggagacuccuacauuguuaucggcgucggggagaagaaaauuacccaccacuggcauagaagcggauccacgaucggcaaggccuuugaagcuacagugcgcggggccaaacggauggcugugcuuggagauaccgccugggacuucggcucugucgggggcgcccugaauagccucggaaagggcauucaccaaaucuucggggcugcguuuaaaucccuguucggaggcaugucuugguuuagccagauccugauugggacacuucucauguggcugggacugaacaccaagaauggcuccaucagccucaugugccuggcccuugggggcgugcugauuuuccucucuaccgcuguuuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11305 - RNA, 2320 nt, Artificial Sequence
  ZIKV (isolate Z1106033) prME-short variant mRNA Design 1 opt
gggagaaagcuuaccaugggcagaaagcagaacaaacgcgggggaaaugagggcagcaucauguggcuggccucccucgcuguggucauugccugcgcgggggcuguuacccggagaggaucugccuacuauauguaccuggaccggaacgaugccggcgaagcuaucagcuuccccacaacgcuugggaugaauaaguguuauauucaaaucauggaccugggacauaccugcgaugccacaauguccuacgaguguccuaugcucgacgaaggcguggagccggaugacguggauugcugguguaacaccacaucuaccugggucguguauggcacaugccaccacaaaaagggggaagcucgcagaagccggcgcgccguuacccugcccucccauucuacgagaaaacuucagacccggagccagacauggcuggagucccgcgaguacaccaagcaccucauuagaguggaaaauuggaucuuucggaacccuggauucgcgcuggccgcugccgcuaucgccuggcugcucggcagcucuacaucccagaaggucauuuaucuggugaugauccuucugauugcgcccgccuacagcauccgcuguauugggguuucuaauagagacuuuguggagggaauguccggcgggaccugggucgauguggugcucgaacauggaggcugcgucacgguuauggcucaagacaaaccuacaguggauaucgagcuggugaccacaaccgucagcaacauggccgaggugcggucuuacuguuaugaggcuuccauuagcgacauggccuccgauucucgcugccccacccagggcgaagccuaccuugacaagcagagcgacacacaguauguuuguaaaagaacgcugguggaucggggguggggaaauggcugcgggcuguucggaaagggcucccuggugaccugcgcuaaauuugcguguagcaagaagaugacagggaaaucuauccaaccugaaaaccuggaguacagaaucaugcucuccgugcacggaagccagcacucuggcaugauuguuaaugacaccggccaugaaacagaugagaaccgcgccaagguggagaucaccccgaauagcccccgggcugaagccacgcucgggggauucggcucccuugggcuggacugcgagccuagaacaggacucgauuuuucugaccuguauuaccuuaccaugaacaauaaacacuggcugguccauaaggaaugguuccacgauauuccccucccuuggcacgccggcgcugacaccgggacaccccauuggaacaacaaagaggcccugguggaauuuaaggaugcgcacgcuaaacgccagaccgucgugguucugggcagccaggagggagccgugcauacagcccucgcuggcgcccuggaggcugaaauggacggggccaagggacggcuuuccagcggccaccugaaguguagacucaaaauggauaagcugcgccuuaaaggggucucuuauucccugugcacggcggccuucaccuuuacaaagaucccggcugagacccuccauggaacagugaccguugaagugcaauacgccggcacggacgggccuuguaaaguccccgcucagauggccguggacaugcagacccugacaccugugggccggcugauuaccgcgaaucccguuaucacagagagcaccgaaaacucuaagaugaugcucgagcuggaucccccuuucggagacuccuacaucgucauuggcgugggggagaagaaaaucacgcaccacuggcauagaagcggauccacaauuggcaaggccuuugaagcuaccgugcgcggggccaaacggauggcuguccuuggagauacagccugggacuucggcucugucgggggcgcccugaauagccucggaaagggcauccaccaaauuuucggggcugcguuuaaaucccuguucggaggcaugucuugguuuagccagauccugaucgggacccuucucauguggcugggacugaacgccaagaauggcuccauuagccucaugugccuggcucuugggggcguucugaucuuccucucuaccgccguguccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11306 - RNA, 2308 nt, Artificial Sequence
  ZIKV (strain MR 766) prME-short variant mRNA Design 1 opt
gggagaaagcuuaccaugggcagaaagcagaacaaacggggcggaaaugagggcagcaucauguggcuggccucccucgcuguggucauugccugcgcgggggcuaucacccgcagaggaucugccuacuauauguaccuggaccggagcgaugccggcaaggcuauuuccuucgccacaacgcuugggguuaacaaaugucacgugcaaaucauggaccugggacauaugugcgaugcuaccaugucuuaugaaugucccaugcucgacgagggcguggaacccgaugacgucgauugcugguguaauacaaccagcacaugggugguuuacgggaccugccaccauaagaaaggggaggcccgcagaucccggcgcgcggugacacugccgucucacagcaccagaaagcugcagacgcggucccagaccuggcuggaaagccgcgaguauacaaagcaucucauuaaagucgagaacuggaucuuuagaaaucccggauucgcccugguggcuguugccaucgcuuggcugcucgggucuuccaccagccagaaggugauuuaccuggucaugauccuucugauugccccugcguauucuauccgguguauugggguguccaaccgcgacuuuguggaaggaaugagcggcgggacaugggucgauguugugcucgagcacggaggcugcgugaccgucauggcccaagacaaacccacgguggauaucgaacugguuacaaccacagugucuaauauggcugaggucagauccuacuguuacgaggccagcauuuccgacauggcuucugauagccggugcccuacccagggcgaagccuaucuugacaagcaguccgacacccaguacguguguaaacgcacacugguugauagaggguggggaaacggcugcggccucuucggaaagggcagccuggugacgugcgccaaguuuaccuguucuaaaaagaugacagggaaauccauccaacccgagaaucuggaauaucggaucaugcucagcguccacggaucucagcauagcggcaugauuggcuacgagaccgacgaagauagagcuaagguggaggucacaccuaacuccccgcgcgcggaggccacccuugggggauucggcucucuugggcuggacugcgaaccccggacgggacucgauuuuagcgaccuguauuaccuuacaaugaauaacaaacacuggcuggugcauaaggagugguuccacgauaucccucuccccuggcacgcuggcgccgacaccgggaccccucauuggaauaacaaagaagcccugguugaguuuaaggaugcucacgccaagagacagacaguggucgugcugggcucccaggaaggagcgguucauaccgcucucgccggcgcccuggaggcugagauggacggggccaaaggacgccuuuucagcggccaccugaagugucggcucaaaauggauaagcugagacuuaaaggggugucuuauucccugugcacagcugccuuuacguucaccaagguccccgcggaaacacuccauggaaccgugacaguggagguucaauacgccggcaccgacgggccguguaagauuccuguccagauggcuguggacaugcagacgcugacccccgugggccgccugaucacagccaauccugucauuaccgaaagcacagagaacucuaaaaugaugcucgaacuggauccucccuuuggagacuccuacaucgugaucggcguuggggauaagaaaauuacccaccacuggcaucggagcggauccacgaucggcaaggcuuucgaggccacagugagaggggcgaaacgcauggccguccuuggagacaccgcuugggauuucggcucuguugggggcguguuuaacagccugggaaagggcauucaccaaaucuucggggccgcuuuuaagucccucuucggaggcaugucuugguuuagccagauucugaucgggacacugcuuguguggcucggacugaauaccaaaaacggcuccaucagccugaccugccucgcccuugggggcgucaugauuuuccugucuacagccguguccgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11307 - RNA, 2320 nt, Artificial Sequence
  ZIKV (strain NatalRGN) prME-short variant mRNA Design 1 opt
gggagaaagcuuaccaugggcagaaagcagaacaaacggggcggaaaugagggcagcaucauguggcuggccucccucgcuguggucauugccugcgcgggggcuguuacccgcagaggaucugccuacuauauguaccuggaccggaacgaugccggcgaagcuaucagcuuccccacaacgcuugggaugaauaaguguuauauucaaaucauggaccugggacacaugugcgaugccaccauguccuacgaguguccuaugcucgacgaaggcguggagccggaugacguggauugcugguguaacacaaccucuacaugggucguguaugggaccugccaucacaaaaagggggaagcucgcagaagccggcgcgccguuacacugcccucccauucuaccagaaaacuucagacgcggagccagaccuggcuggagucccgcgaguacacaaagcaccucauuagaguggaaaauuggaucuuucggaacccuggauucgcgcuggccgcugccgcuaucgccuggcugcucggcagcucuaccucccagaaggucauuuaucuggugaugauccuucugauugcgcccgccuacagcauccgcuguauugggguuucuaauagagacuuuguggagggaauguccggcgggacaugggucgauguggugcucgaacauggaggcugcgucaccguuauggcucaagacaaaccuacgguggauaucgagcuggugacaaccacagucagcaacauggccgaggugcggucuuacuguuaugaggcuuccauuagcgacauggccuccgauucucgcugccccacccagggcgaagccuaccuugacaagcagagcgacacccaguauguuuguaaaagaacacugguggaucggggguggggaaauggcugcgggcuguucggaaagggcucccuggucacgugcgcuaaauuugcguguagcaagaagaugaccgggaaaucuauccaaccugaaaaccuggaguacagaaucaugcucuccgugcacggaagccagcacucuggcaugauuguuaaugacacaggccaugaaaccgaugagaaccgcgccaagguggagaucacaccgaauagcccccgggcugaagccacccucgggggauucggcucccuugggcuggacugcgagccuagaacgggacucgauuuuucugaccuguauuaccuuacaaugaacaauaaacacuggcugguccauaaggaaugguuccacgauauuccccucccuuggcacgccggcgcugacaccgggacaccccauuggaacaacaaagaggcccugguggaauuuaaggaugcgcacgcuaaacgccagaccgucgugguucugggcagccaggagggagccgugcauaccgcccucgcuggcgcccuggaggcugaaauggacggggccaagggacggcuuuccagcggccaccugaaguguagacucaaaauggauaagcugcgccuuaaaggggucucuuauucccugugcacagcggccuucacguuuaccaagaucccggcugagacacuccauggaaccgugacaguugaagugcaauacgccggcaccgacgggccuuguaaaguccccgcucagauggccguggacaugcagacgcugaccccugugggccggcugauuacagcgaaucccguuaucaccgagagcacagaaaacucuaagaugaugcucgagcuggaucccccuuucggagacuccuacaucgucauuggcgugggggagaagaaaaucacccaccacuggcauagaagcggauccacgauuggcaaggccuuugaagcuacagugcgcggggccaaacggauggcuguccuuggagauaccgccugggacuucggcucuguugggggcgcccugaauagccucggaaagggcauccaccaaauuuucggggcugcguuuaaaucccuguucggaggcaugucuugguuuagccagauccugaucgggacacuucucauguggcugggacugaacaccaagaauggcuccauuagccucaugugccuggcccuugggggcgugcugaucuuccucucuaccgcuguguccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11308 - RNA, 2293 nt, Artificial Sequence
  ZIKV (strain ZikaSPH2015) prME-short variant mRNA Design 1 opt
gggagaaagcuuaccaugaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacacaugugcgaugccaccauguccuacgaguguccuaugcucgacgaaggcguggagccggaugacguggauugcugguguaauacaaccucuacaugggucguguaugggaccugccaucacaaaaagggagaagcuagacggagccgcagagccguuacacugcccucccauucuacccggaaacuucaaacgcgcagccagaccuggcuggaguccagagaguacacaaagcaccucauucggguggaaaacuggaucuuucgcaauccuggcuucgcgcuggccgcugccgcuaucgccuggcugcucggcagcucuaccucccagaaagucauuuaucuggugaugauccuucugauugcgcccgccuacagcaucagauguauugggguuucuaaccgggacuuuguggagggaauguccggcgggacaugggucgauaucgugcucgaacauggaggcugcgugaccgucauggcucaggacaagccuacgguugauauugagcuggugacaaccacagugagcaauauggccgagguccgcucuuacuguuaugaggcuuccaucagcgacauggccuccgauucuagaugccccacccaaggggaagccuaccuugacaagcagagcgacacccaguauguguguaaacggacacugguugaucgcggauggggcaacggcugcggacucuucgggaagggcucccuggugacgugcgcuaaauuugcguguagcaagaaaaugaccgggaagucuauccagccugaaaaucuggaguacagaauuaugcucuccguccacggaagccaacacucuggcaugaucgugaacgacacagggcaugaaaccgaugagaaucgggccaagguugagauuacaccgaacagccccagagcugaagccacccugggaggcuucggcucccuugggcuggacugcgagccucgcacgggacucgauuuuucugaccuguauuaccuuacaaugaauaacaaacacuggcuggugcauaaggaaugguuccacgauaucccccucccuuggcacgccggcgcugacaccgggacaccccauuggaauaacaaagaggcccuggucgaauuuaaggaugcgcacgcuaaacggcagaccguggucgugcugggaagccaggagggcgccguucauaccgcccucgcuggggcccuggaggcugaaauggacggcgccaagggaagacuuuccagcggccaccugaaaugucgccucaagauggauaagcugcggcuuaaaggggugucuuauucccugugcacagcggccuucacguuuaccaagauuccggcugagacacuccauggaaccgucacaguggaaguucaguacgccggcaccgacgggccuuguaaagugcccgcucaaauggccgucgacaugcagacgcugaccccugugggaagacugaucacagcgaaccccgugaucaccgagagcacagaaaauucuaagaugaugcucgagcuggaucccccuuucggcgacuccuacauuguuaucggggucggcgagaaaaagauuacccaccacuggcaucgcagcggauccacgaucggcaaggccuuugaagcuacagugagaggggccaaacggauggcugugcuuggagauaccgccugggacuucggcucugucgggggagcccugaacagccucggcaaggggauucaccagaucuucggcgcugcguuuaaaucccuguucggaggcaugucuugguuuagccaaauccugauugggacacuucucauguggcugggacugaauaccaagaacggcuccaucagccucaugugccuggcccuugggggagugcugauuuuccucucuaccgcuguuuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11309 - RNA, 2293 nt, Artificial Sequence
  ZIKV (isolate Z1106033) prME-short variant mRNA Design 1 opt
gggagaaagcuuaccaugaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacauaccugcgaugccacaauguccuacgaguguccuaugcucgacgaaggcguggagccggaugacguggauugcugguguaauaccacaucuaccugggucguguaugggacaugccaccacaaaaagggagaagcuagacggagccgcagagccguuacccugcccucccauucuacgcggaaacuucaaacccgcagccagacauggcuggaguccagagaguacaccaagcaccucauucggguggaaaacuggaucuuucgcaauccuggcuucgcgcuggccgcugccgcuaucgccuggcugcucggcagcucuacaucccagaaagucauuuaucuggugaugauccuucugauugcgcccgccuacagcaucagauguauugggguuucuaaccgggacuuuguggagggaauguccggcgggaccugggucgauguggugcucgaacauggaggcugcgucacgguuauggcucaggacaagccuacaguggauaucgagcuggugaccacaaccgucagcaauauggccgaggugcgcucuuacuguuaugaggcuuccauuagcgacauggccuccgauucuagaugccccacccaaggggaagccuaccuugacaagcagagcgacacacaguauguuuguaaacggacgcugguggaucgcggauggggcaacggcugcggacucuucgggaagggcucccuggugaccugcgcuaaauuugcguguagcaagaaaaugacagggaagucuauccagccugaaaaucuggaguacagaaucaugcucuccgugcacggaagccaacacucuggcaugauuguuaacgacaccgggcaugaaacagaugagaaucgggccaagguggagaucaccccgaacagccccagagcugaagccacgcugggaggcuucggcucccuugggcuggacugcgagccucgcacaggacucgauuuuucugaccuguauuaccuuaccaugaauaacaaacacuggcugguccauaaggaaugguuccacgauauuccccucccuuggcacgccggcgcugacaccgggacaccccauuggaauaacaaagaggcccugguggaauuuaaggaugcgcacgcuaaacggcagaccgucgugguucugggaagccaggagggcgccgugcauacagcccucgcuggggcccuggaggcugaaauggacggcgccaagggaagacuuuccagcggccaccugaaaugucgccucaagauggauaagcugcggcuuaaaggggucucuuauucccugugcacggcggccuucaccuuuacaaagaucccggcugagacccuccauggaacagugaccguugaagugcaguacgccggcacggacgggccuuguaaaguccccgcucaaauggccguggacaugcagacccugacaccugugggaagacugauuaccgcgaaccccguuaucacagagagcaccgaaaauucuaagaugaugcucgagcuggaucccccuuucggcgacuccuacaucgucauuggggugggcgagaaaaagaucacgcaccacuggcaucgcagcggauccacaauuggcaaggccuuugaagcuaccgugagaggggccaaacggauggcuguccuuggagauacagccugggacuucggcucugucgggggagcccugaacagccucggcaaggggauccaccagauuuucggcgcugcguuuaaaucccuguucggaggcaugucuugguuuagccaaauccugaucgggacccuucucauguggcugggacugaaugccaagaacggcuccauuagccucaugugccuggcucuugggggaguucugaucuuccucucuaccgccguguccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11310 - RNA, 2281 nt, Artificial Sequence
  ZIKV (strain MR 766) prME-short variant mRNA Design 1 opt
gggagaaagcuuaccaugaacgagggcagcaucauguggcuggccucccucgcuguggucauugccugcgcgggggcuaucaccagacggggaucugccuacuauauguaccuggaccgcagcgaugccggcaaggcuauuuccuucgccacaacgcuugggguuaauaaaugucacgugcagaucauggaccugggacauaugugcgaugcuaccaugucuuaugaaugucccaugcucgacgagggcguggaacccgaugacgucgauugcugguguaacacaaccagcacaugggugguuuacgggaccugccaccauaagaaaggagaggccagacggucccgcagagcggugacacugccgucucacagcacccggaagcugcaaacgcgcucccagaccuggcuggaaagcagagaguauacaaaacaucucauuaaggucgagaauuggaucuuucggaaccccggcuucgcccugguggcuguugccaucgcuuggcugcucgggucuuccaccagccagaaggugauuuaccuggucaugauccuucugauugccccugcguauucuauccgcuguauugggguguccaauagagacuuuguggaaggaaugagcggcgggacaugggucgauguugugcucgagcacggaggcugcgugaccgucauggcccaggacaaacccacgguggauaucgaacugguuacaaccacagugucuaacauggcugagguccgguccuacuguuacgaggccagcauuuccgacauggcuucugauagccgcugcccuacccaaggggaagccuaucuugacaagcaguccgacacccaguacguguguaaaagaacacugguugaucggggauggggcaauggcugcggccucuucggaaagggcagccuggugacgugcgccaaauuuaccuguucuaagaagaugacagggaaauccauccagcccgagaaccuggaauaucgcaucaugcucagcguccacggaucucaacauagcggcaugauuggguacgagaccgacgaagauagagcuaagguggaggucacaccuaauuccccgcgggcggaggccacccugggaggcuucggcucucuugggcuggacugcgaacccagaacgggacucgauuuuagcgaccuguauuaccuuacaaugaacaauaaacacuggcuggugcauaaggagugguuccacgauaucccucuccccuggcacgcuggcgccgacaccgggaccccucauuggaacaauaaagaagcccugguugaguuuaaggaugcucacgccaaacgccagacaguggucgugcugggaucccaggaaggcgcgguucauaccgcucucgccggggcccuggaggcugagauggacggcgccaagggacggcuuuucagcggccaccugaaguguagacucaaaauggauaagcugcgccuuaaaggggugucuuauucccugugcacagcugccuuuacguucaccaagguccccgcggaaacacuccauggaaccgugacaguggagguucaguacgccggcaccgacgggccguguaaaauuccuguccaaauggcuguggacaugcagacgcugacccccgugggacggcugaucacagccaacccugucauuaccgaaagcacagaaaauucuaagaugaugcucgagcuggauccucccuuuggcgacuccuacaucgugaucgggguuggcgauaagaaaauuacccaccacuggcauagaagcggauccacgaucggcaaggcuuucgaggccacagugcgcggggcgaaacggauggccguccuuggagacaccgcuugggauuucggcucuguugggggaguguuuaacagccugggcaaggggauucaccagaucuucggcgccgcuuuuaaaucccucuucggaggcaugucuugguuuagccaaauucugaucgggacacugcuuguguggcucggacugaacaccaagaauggcuccaucagccugaccugccucgcccuugggggagucaugauuuuccuuucuacagccguguccgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11311 - RNA, 2293 nt, Artificial Sequence
  ZIKV (strain NatalRGN) prME-short variant mRNA Design 1 opt
gggagaaagcuuaccaugaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacacaugugcgaugccaccauguccuacgaguguccuaugcucgacgaaggcguggagccggaugacguggauugcugguguaauacaaccucuacaugggucguguaugggaccugccaucacaaaaagggagaagcuagacggagccgcagagccguuacacugcccucccauucuacccggaaacuucaaacgcgcagccagaccuggcuggaguccagagaguacacaaagcaccucauucggguggaaaacuggaucuuucgcaauccuggcuucgcgcuggccgcugccgcuaucgccuggcugcucggcagcucuaccucccagaaagucauuuaucuggugaugauccuucugauugcgcccgccuacagcaucagauguauugggguuucuaaccgggacuuuguggagggaauguccggcgggacaugggucgauguggugcucgaacauggaggcugcgucaccguuauggcucaggacaagccuacgguggauaucgagcuggugacaaccacagucagcaauauggccgaggugcgcucuuacuguuaugaggcuuccauuagcgacauggccuccgauucuagaugccccacccaaggggaagccuaccuugacaagcagagcgacacccaguauguuuguaaacggacacugguggaucgcggauggggcaacggcugcggacucuucgggaagggcucccuggucacgugcgcuaaauuugcguguagcaagaaaaugaccgggaagucuauccagccugaaaaucuggaguacagaaucaugcucuccgugcacggaagccaacacucuggcaugauuguuaacgacacagggcaugaaaccgaugagaaucgggccaagguggagaucacaccgaacagccccagagcugaagccacccugggaggcuucggcucccuugggcuggacugcgagccucgcacgggacucgauuuuucugaccuguauuaccuuacaaugaauaacaaacacuggcugguccauaaggaaugguuccacgauauuccccucccuuggcacgccggcgcugacaccgggacaccccauuggaauaacaaagaggcccugguggaauuuaaggaugcgcacgcuaaacggcagaccgucgugguucugggaagccaggagggcgccgugcauaccgcccucgcuggggcccuggaggcugaaauggacggcgccaagggaagacuuuccagcggccaccugaaaugucgccucaagauggauaagcugcggcuuaaaggggucucuuauucccugugcacagcggccuucacguuuaccaagaucccggcugagacacuccauggaaccgugacaguugaagugcaguacgccggcaccgacgggccuuguaaaguccccgcucaaauggccguggacaugcagacgcugaccccugugggaagacugauuacagcgaaccccguuaucaccgagagcacagaaaauucuaagaugaugcucgagcuggaucccccuuucggcgacuccuacaucgucauuggggugggcgagaaaaagaucacccaccacuggcaucgcagcggauccacgauuggcaaggccuuugaagcuacagugagaggggccaaacggauggcuguccuuggagauaccgccugggacuucggcucuguugggggagcccugaacagccucggcaaggggauccaccagauuuucggcgcugcguuuaaaucccuguucggaggcaugucuugguuuagccaaauccugaucgggacacuucucauguggcugggacugaauaccaagaacggcuccauuagccucaugugccuggcccuugggggagugcugaucuuccucucuaccgcuguguccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11312 - RNA, 2320 nt, Artificial Sequence
  ZIKV (strain ZikaSPH2015) prME-short variant mRNA Design 1 opt
gggagaaagcuuaccaugggcagaaagcagaacaaacggggcggaaaugagggcagcaucauguggcuggccucccucgcuguggucauugccugcgcgggggcuguuacccgcagaggaucugccuacuauauguaccuggaccggaacgaugccggcgaagcuaucagcuuccccacaacgcuugggaugaauaaguguuauauucaaaucauggaccugggacacaugugcgaugccaccauguccuacgaguguccuaugcucgacgaaggcguggagccggaugacguggauugcugguguaacacaaccucuacaugggucguguaugggaccugccaucacaaaaagggggaagcucgcagaagccggcgcgccguuacacugcccucccauucuaccagaaaacuucagacgcggagccagaccuggcuggagucccgcgaguacacaaagcaccucauuagaguggaaaauuggaucuuucggaacccuggauucgcgcuggccgcugccgcuaucgccuggcugcucggcagcucuaccucccagaaggucauuuaucuggugaugauccuucugauugcgcccgccuacagcauccgcuguauugggguuucuaauagagacuuuguggagggaauguccggcgggacaugggucgauaucgugcucgaacauggaggcugcgugaccgucauggcucaagacaaaccuacgguugauauugagcuggugacaaccacagugagcaacauggccgagguccggucuuacuguuaugaggcuuccaucagcgacauggccuccgauucucgcugccccacccagggcgaagccuaccuugacaagcagagcgacacccaguauguguguaaaagaacacugguugaucggggguggggaaauggcugcgggcuguucggaaagggcucccuggugacgugcgcuaaauuugcguguagcaagaagaugaccgggaaaucuauccaaccugaaaaccuggaguacagaauuaugcucuccguccacggaagccagcacucuggcaugaucgugaaugacacaggccaugaaaccgaugagaaccgcgccaagguugagauuacaccgaauagcccccgggcugaagccacccucgggggauucggcucccuugggcuggacugcgagccuagaacgggacucgauuuuucugaccuguauuaccuuacaaugaacaauaaacacuggcuggugcauaaggaaugguuccacgauaucccccucccuuggcacgccggcgcugacaccgggacaccccauuggaacaacaaagaggcccuggucgaauuuaaggaugcgcacgcuaaacgccagaccguggucgugcugggcagccaggagggagccguucauaccgcccucgcuggcgcccuggaggcugaaauggacggggccaagggacggcuuuccagcggccaccugaaguguagacucaaaauggauaagcugcgccuuaaaggggugucuuauucccugugcacagcggccuucacguuuaccaagauuccggcugagacacuccauggaaccgucacaguggaaguucaauacgccggcaccgacgggccuuguaaagugcccgcucagauggccgucgacaugcagacgcugaccccugugggccggcugaucacagcgaaucccgugaucaccgagagcacagaaaacucuaagaugaugcucgagcuggaucccccuuucggagacuccuacauuguuaucggcgucggggagaagaaaauuacccaccacuggcauagaagcggauccacgcuuggcaaggccuuuucuacaacccugaaaggggcucaacgccucgccgcucugggagauacagccugggacuucggcagcaucgggggcguguucaauuccauuggacgggccgugcaccaggucuuuggcggggcuuucagaacccuguuuggaggcaugucuuggaucacccaggggcuuaugggagcgcuccugcuguggaugggcgugaacgcccgcgaucggagcaucgcucucgccuuccuggccacagggggcguucuuguguuucuggcuacgaauguccaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11313 - RNA, 2320 nt, Artificial Sequence
  ZIKV (isolate Z1106033) prME-short variant mRNA Design 1 opt
gggagaaagcuuaccaugggcagaaagcagaacaaacgcgggggaaaugagggcagcaucauguggcuggccucccucgcuguggucauugccugcgcgggggcuguuacccggagaggaucugccuacuauauguaccuggaccggaacgaugccggcgaagcuaucagcuuccccacaacgcuugggaugaauaaguguuauauucaaaucauggaccugggacacacgugcgaugccacaauguccuacgaguguccuaugcucgacgaaggcguggagccggaugacguggauugcugguguaacaccacaucuaccugggucguguauggcacaugccaucacaaaaagggggaagcucgcagaagccggcgcgccguuacccugcccucccauucuacgagaaaacuucagacccggagccagacauggcuggagucccgcgaguacaccaagcaccucauuagaguggaaaauuggaucuuucggaacccuggauucgcgcuggccgcugccgcuaucgccuggcugcucggcagcucuacaucccagaaggucauuuaucuggugaugauccuucugauugcgcccgccuacagcauccgcuguauugggguuucuaauagagacuuuguggagggaauguccggcgggaccugggucgauguggugcucgaacauggaggcugcgucacgguuauggcucaagacaaaccuacaguggauaucgagcuggugaccacaaccgucagcaacauggccgaggugcggucuuacuguuaugaggcuuccauuagcgacauggccuccgauucucgcugccccacccagggcgaagccuaccuugacaagcagagcgacacacaguauguuuguaaaagaacgcugguggaucggggguggggaaauggcugcgggcuguucggaaagggcucccuggugaccugcgcuaaauuugcguguagcaagaagaugacagggaaaucuauccaaccugaaaaccuggaguacagaaucaugcucuccguccacggaagccagcacucuggcaugauuguuaaugacaccggccaugaaacagaugagaaccgcgccaagguggagaucaccccgaauagcccccgggcugaagccacgcucgggggauucggcucccuugggcuggacugcgagccuagaacaggacucgauuuuucugaccuguauuaccuuaccaugaacaauaaacacuggcugguccauaaggaaugguuccacgauauuccccucccuuggcacgccggcgcugacaccgggacaccccauuggaacaacaaagaggcccugguggaauuuaaggaugcgcacgcuaaacgccagaccgucgugguucugggcagccaggagggagccgugcauacagcccucgcuggcgcccuggaggcugaaauggacggggccaagggacggcuuuccagcggccaccugaaguguagacucaaaauggauaagcugcgccuuaaaggggucucuuauucccugugcacggcggccuucaccuuuacaaagaucccggcugagacccuccauggaacagugaccguugaagugcaauacgccggcacggacgggccuuguaaaguccccgcucagauggccguggacaugcagacccugacaccugugggccggcugauuaccgcgaaucccguuaucacagagagcaccgaaaacucuaagaugaugcucgagcuggaucccccuuucggagacuccuacaucgucauuggcgugggggagaagaaaaucacgcaccacuggcauagaagcggauccacacuuggcaaggccuuuucuaccacacugaaaggggcucaacgccucgccgcucugggagauaccgccugggacuucggcagcauugggggcguguucaauuccaucggacgggccguccaccagguguuuggcggggcuuucagaacccuguuuggaggcaugucuuggauuacacaggggcuuaugggagcgcuccugcuguggaugggcguuaacgcccgcgaucggagcaucgcucucgccuuccuggccaccgggggcgugcuugucuuucuggcuaccaaugugcaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11314 - RNA, 2308 nt, Artificial Sequence
  ZIKV (strain MR 766) prME-short variant mRNA Design 1 opt
gggagaaagcuuaccaugggcagaaagcagaacaaacggggcggaaaugagggcagcaucauguggcuggccucccucgcuguggucauugccugcgcgggggcuaucacccgcagaggaucugccuacuauauguaccuggaccggagcgaugccggcaaggcuauuuccuucgccacaacgcuugggguuaacaaaugucacgugcaaaucauggaccugggacauaugugcgaugcuaccaugucuuaugaaugucccaugcucgacgagggcguggaacccgaugacgucgauugcugguguaauacaaccagcacaugggugguuuacgggaccugccaccauaagaaaggggaggcccgcagaucccggcgcgcggugacacugccgucucacagcaccagaaagcugcagacgcggucccagaccuggcuggaaagccgcgaguauacaaagcaucucauuaaagucgagaacuggaucuuuagaaaucccggauucgcccugguggcuguugccaucgcuuggcugcucgggucuuccaccagccagaaggugauuuaccuggucaugauccuucugauugccccugcguauucuauccgguguauugggguguccaaccgcgacuuuguggaaggaaugagcggcgggacaugggucgauguugugcucgagcacggaggcugcgugaccgucauggcccaagacaaacccacgguggauaucgaacugguuacaaccacagugucuaauauggcugaggucagauccuacuguuacgaggccagcauuuccgacauggcuucugauagccggugcccuacccagggcgaagccuaucuugacaagcaguccgacacccaguacguguguaaacgcacacugguugauagaggguggggaaacggcugcggccucuucggaaagggcagccuggugacgugcgccaaguuuaccuguucuaaaaagaugacagggaaauccauccaacccgagaaucuggaauaucggaucaugcucagcguccacggaucucagcauagcggcaugauuggcuacgagaccgacgaagauagagcuaagguggaggucacaccuaacuccccgcgcgcggaggccacccuugggggauucggcucucuugggcuggacugcgaaccccggacgggacucgauuuuagcgaccuguauuaccuuacaaugaauaacaaacacuggcuggugcauaaggagugguuccacgauaucccucuccccuggcacgcuggcgccgacaccgggaccccucauuggaauaacaaagaagcccugguugaguuuaaggaugcucacgccaagagacagacaguggucgugcugggcucccaggaaggagcgguucauaccgcucucgccggcgcccuggaggcugagauggacggggccaaaggacgccuuuucagcggccaccugaagugucggcucaaaauggauaagcugagacuuaaaggggugucuuauucccugugcacagcugccuuuacguucaccaagguccccgcggaaacacuccauggaaccgugacaguggagguucaauacgccggcaccgacgggccguguaagauuccuguccagauggcuguggacaugcagacgcugacccccgugggccgccugaucacagccaauccugucauuaccgaaagcacagagaacucuaaaaugaugcucgaacuggauccucccuuuggagacuccuacaucgugaucggcguuggggauaagaaaauuacccaccacuggcaucggagcggauccacgcuuggcaaggcuuucucuacaacccugaaaggggcccaaagacucgcggcccugggagacacagcuugggauuucggcagcaucgggggcguguuuaacuccauuggacgcgccguccaccagguguucggcggggcuuuucggacccuguucggaggcaugucuuggaucacccaggggcuuaugggagcccuccugcuguggaugggcguuaaugccagagaccgcagcauugcucucgcguuucuggccacagggggcgugcuugucuuccuggcuacgaacgugcaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11315 - RNA, 2320 nt, Artificial Sequence
  ZIKV (strain NatalRGN) prME-short variant mRNA Design 1 opt
gggagaaagcuuaccaugggcagaaagcagaacaaacggggcggaaaugagggcagcaucauguggcuggccucccucgcuguggucauugccugcgcgggggcuguuacccgcagaggaucugccuacuauauguaccuggaccggaacgaugccggcgaagcuaucagcuuccccacaacgcuugggaugaauaaguguuauauucaaaucauggaccugggacacaugugcgaugccaccauguccuacgaguguccuaugcucgacgaaggcguggagccggaugacguggauugcugguguaacacaaccucuacaugggucguguaugggaccugccaucacaaaaagggggaagcucgcagaagccggcgcgccguuacacugcccucccauucuaccagaaaacuucagacgcggagccagaccuggcuggagucccgcgaguacacaaagcaccucauuagaguggaaaauuggaucuuucggaacccuggauucgcgcuggccgcugccgcuaucgccuggcugcucggcagcucuaccucccagaaggucauuuaucuggugaugauccuucugauugcgcccgccuacagcauccgcuguauugggguuucuaauagagacuuuguggagggaauguccggcgggacaugggucgauguggugcucgaacauggaggcugcgucaccguuauggcucaagacaaaccuacgguggauaucgagcuggugacaaccacagucagcaacauggccgaggugcggucuuacuguuaugaggcuuccauuagcgacauggccuccgauucucgcugccccacccagggcgaagccuaccuugacaagcagagcgacacccaguauguuuguaaaagaacacugguggaucggggguggggaaauggcugcgggcuguucggaaagggcucccuggucacgugcgcuaaauuugcguguagcaagaagaugaccgggaaaucuauccaaccugaaaaccuggaguacagaaucaugcucuccgugcacggaagccagcacucuggcaugauuguuaaugacacaggccaugaaaccgaugagaaccgcgccaagguggagaucacaccgaauagcccccgggcugaagccacccucgggggauucggcucccuugggcuggacugcgagccuagaacgggacucgauuuuucugaccuguauuaccuuacaaugaacaauaaacacuggcugguccauaaggaaugguuccacgauauuccccucccuuggcacgccggcgcugacaccgggacaccccauuggaacaacaaagaggcccugguggaauuuaaggaugcgcacgcuaaacgccagaccgucgugguucugggcagccaggagggagccgugcauaccgcccucgcuggcgcccuggaggcugaaauggacggggccaagggacggcuuuccagcggccaccugaaguguagacucaaaauggauaagcugcgccuuaaaggggucucuuauucccugugcacagcggccuucacguuuaccaagaucccggcugagacacuccauggaaccgugacaguugaagugcaauacgccggcaccgacgggccuuguaaaguccccgcucagauggccguggacaugcagacgcugaccccugugggccggcugauuacagcgaaucccguuaucaccgagagcacagaaaacucuaagaugaugcucgagcuggaucccccuuucggagacuccuacaucgucauuggcgugggggagaagaaaaucacccaccacuggcauagaagcggauccacgcuuggcaaggccuuuucuacaacccugaaaggggcucaacgccucgccgcucugggagauacagccugggacuucggcagcauugggggcguguucaauuccaucggacgggccguccaccagguguuuggcggggcuuucagaacccuguuuggaggcaugucuuggauuacccaggggcuuaugggagcgcuccugcuguggaugggcguuaacgcccgcgaucggagcaucgcucucgccuuccuggccacagggggcgugcuugucuuucuggcuacgaaugugcaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11316 - RNA, 2293 nt, Artificial Sequence
  ZIKV (strain ZikaSPH2015) prME-short variant mRNA Design 1 opt
gggagaaagcuuaccaugaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacacaugugcgaugccaccauguccuacgaguguccuaugcucgacgaaggcguggagccggaugacguggauugcugguguaauacaaccucuacaugggucguguaugggaccugccaucacaaaaagggagaagcuagacggagccgcagagccguuacacugcccucccauucuacccggaaacuucaaacgcgcagccagaccuggcuggaguccagagaguacacaaagcaccucauucggguggaaaacuggaucuuucgcaauccuggcuucgcgcuggccgcugccgcuaucgccuggcugcucggcagcucuaccucccagaaagucauuuaucuggugaugauccuucugauugcgcccgccuacagcaucagauguauugggguuucuaaccgggacuuuguggagggaauguccggcgggacaugggucgauaucgugcucgaacauggaggcugcgugaccgucauggcucaggacaagccuacgguugauauugagcuggugacaaccacagugagcaauauggccgagguccgcucuuacuguuaugaggcuuccaucagcgacauggccuccgauucuagaugccccacccaaggggaagccuaccuugacaagcagagcgacacccaguauguguguaaacggacacugguugaucgcggauggggcaacggcugcggacucuucgggaagggcucccuggugacgugcgcuaaauuugcguguagcaagaaaaugaccgggaagucuauccagccugaaaaucuggaguacagaauuaugcucuccguccacggaagccaacacucuggcaugaucgugaacgacacagggcaugaaaccgaugagaaucgggccaagguugagauuacaccgaacagccccagagcugaagccacccugggaggcuucggcucccuugggcuggacugcgagccucgcacgggacucgauuuuucugaccuguauuaccuuacaaugaauaacaaacacuggcuggugcauaaggaaugguuccacgauaucccccucccuuggcacgccggcgcugacaccgggacaccccauuggaauaacaaagaggcccuggucgaauuuaaggaugcgcacgcuaaacggcagaccguggucgugcugggaagccaggagggcgccguucauaccgcccucgcuggggcccuggaggcugaaauggacggcgccaagggaagacuuuccagcggccaccugaaaugucgccucaagauggauaagcugcggcuuaaaggggugucuuauucccugugcacagcggccuucacguuuaccaagauuccggcugagacacuccauggaaccgucacaguggaaguucaguacgccggcaccgacgggccuuguaaagugcccgcucaaauggccgucgacaugcagacgcugaccccugugggaagacugaucacagcgaaccccgugaucaccgagagcacagaaaauucuaagaugaugcucgagcuggaucccccuuucggcgacuccuacauuguuaucggggucggcgagaaaaagauuacccaccacuggcaucgcagcggauccacgcuuggcaaggccuuuucuacaacccugaaaggggcucagcggcucgccgcucugggagauacagccugggacuucggcagcaucgggggaguguucaacuccauuggcagagccgugcaccaagucuuugggggcgcuuuccgcacccuguuuggaggcaugucuuggaucacccaggggcuuaugggagcgcuccugcuguggaugggcgugaaugcccgggauagaagcaucgcucucgccuuccuggccacagggggaguucuuguguuucuggcuacgaacguccaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11317 - RNA, 2293 nt, Artificial Sequence
  ZIKV (isolate Z1106033) prME-short variant mRNA Design 1 opt
gggagaaagcuuaccaugaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacacacgugcgaugccacaauguccuacgaguguccuaugcucgacgaaggcguggagccggaugacguggauugcugguguaauaccacaucuaccugggucguguaugggacaugccaucacaaaaagggagaagcuagacggagccgcagagccguuacccugcccucccauucuacgcggaaacuucaaacccgcagccagacauggcuggaguccagagaguacaccaagcaccucauucggguggaaaacuggaucuuucgcaauccuggcuucgcgcuggccgcugccgcuaucgccuggcugcucggcagcucuacaucccagaaagucauuuaucuggugaugauccuucugauugcgcccgccuacagcaucagauguauugggguuucuaaccgggacuuuguggagggaauguccggcgggaccugggucgauguggugcucgaacauggaggcugcgucacgguuauggcucaggacaagccuacaguggauaucgagcuggugaccacaaccgucagcaauauggccgaggugcgcucuuacuguuaugaggcuuccauuagcgacauggccuccgauucuagaugccccacccaaggggaagccuaccuugacaagcagagcgacacacaguauguuuguaaacggacgcugguggaucgcggauggggcaacggcugcggacucuucgggaagggcucccuggugaccugcgcuaaauuugcguguagcaagaaaaugacagggaagucuauccagccugaaaaucuggaguacagaaucaugcucuccguccacggaagccaacacucuggcaugauuguuaacgacaccgggcaugaaacagaugagaaucgggccaagguggagaucaccccgaacagccccagagcugaagccacgcugggaggcuucggcucccuugggcuggacugcgagccucgcacaggacucgauuuuucugaccuguauuaccuuaccaugaauaacaaacacuggcugguccauaaggaaugguuccacgauauuccccucccuuggcacgccggcgcugacaccgggacaccccauuggaauaacaaagaggcccugguggaauuuaaggaugcgcacgcuaaacggcagaccgucgugguucugggaagccaggagggcgccgugcauacagcccucgcuggggcccuggaggcugaaauggacggcgccaagggaagacuuuccagcggccaccugaaaugucgccucaagauggauaagcugcggcuuaaaggggucucuuauucccugugcacggcggccuucaccuuuacaaagaucccggcugagacccuccauggaacagugaccguugaagugcaguacgccggcacggacgggccuuguaaaguccccgcucaaauggccguggacaugcagacccugacaccugugggaagacugauuaccgcgaaccccguuaucacagagagcaccgaaaauucuaagaugaugcucgagcuggaucccccuuucggcgacuccuacaucgucauuggggugggcgagaaaaagaucacgcaccacuggcaucgcagcggauccacacuuggcaaggccuuuucuaccacacugaaaggggcucagcggcucgccgcucugggagauaccgccugggacuucggcagcauugggggaguguucaacuccaucggcagagccguccaccaaguguuugggggcgcuuuccgcacccuguuuggaggcaugucuuggauuacacaggggcuuaugggagcgcuccugcuguggaugggcguuaaugcccgggauagaagcaucgcucucgccuuccuggccaccgggggagugcuugucuuucuggcuaccaacgugcaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11318 - RNA, 2281 nt, Artificial Sequence
  ZIKV (strain MR 766) prME-short variant mRNA Design 1 opt
gggagaaagcuuaccaugaacgagggcagcaucauguggcuggccucccucgcuguggucauugccugcgcgggggcuaucaccagacggggaucugccuacuauauguaccuggaccgcagcgaugccggcaaggcuauuuccuucgccacaacgcuugggguuaauaaaugucacgugcagaucauggaccugggacauaugugcgaugcuaccaugucuuaugaaugucccaugcucgacgagggcguggaacccgaugacgucgauugcugguguaacacaaccagcacaugggugguuuacgggaccugccaccauaagaaaggagaggccagacggucccgcagagcggugacacugccgucucacagcacccggaaacuucaaacgcgcucccagaccuggcuggaaagcagagaguauacaaagcaucucauuaaggucgagaauuggaucuuucggaaccccggcuucgcccugguggcuguugccaucgcuuggcugcucgggucuuccaccagccagaaggugauuuaccuggucaugauccuucugauugccccugcguauucuauccgcuguauugggguguccaauagagacuuuguggaaggaaugagcggcgggacaugggucgauguugugcucgagcacggaggcugcgugaccgucauggcccaggacaaacccacgguggauaucgaacugguuacaaccacagugucuaacauggcugagguccgguccuacuguuacgaggccagcauuuccgacauggcuucugauagccgcugcccuacccaaggggaagccuaucuugacaagcaguccgacacccaguacguguguaaaagaacacugguugaucggggauggggcaauggcugcggccucuucggaaagggcagccuggugacgugcgccaaauuuaccuguucuaagaagaugacagggaaauccauccagcccgagaaccuggaauaucgcaucaugcucagcguccacggaucucaacauagcggcaugauuggguacgagaccgacgaagauagagcuaagguggaggucacaccuaauuccccgcgggcggaggccacccugggaggcuucggcucucuugggcuggacugcgaacccagaacgggacucgauuuuagcgaccuguauuaccuuacaaugaacaauaaacacuggcuggugcauaaggagugguuccacgauaucccucuccccuggcacgcuggcgccgacaccgggaccccucauuggaacaauaaagaagcccugguugaguuuaaggaugcucacgccaaacgccagacaguggucgugcugggaucccaggaaggcgcgguucauaccgcucucgccggggcccuggaggcugagauggacggcgccaagggacggcuuuucagcggccaccugaaguguagacucaaaauggauaagcugcgccuuaaaggggugucuuauucccugugcacagcugccuuuacguucaccaagguccccgcggaaacacuccauggaaccgugacaguggagguucaguacgccggcaccgacgggccguguaaaauuccuguccaaauggcuguggacaugcagacgcugacccccgugggacggcugaucacagccaacccugucauuaccgaaagcacagaaaauucuaagaugaugcucgagcuggauccucccuuuggcgacuccuacaucgugaucgggguuggcgauaagaaaauuacccaccacuggcauagaagcggauccacgcuuggcaaggcuuucucuacaacccugaaaggggcccagcgccucgcggcccugggagacacagcuugggauuucggcagcaucgggggaguguuuaacuccauuggccgggccguccaccaaguguucgggggcgcuuuuagaacccuguucggaggcaugucuuggaucacccaggggcuuaugggagcccuccugcuguggaugggcguuaacgcccgcgaccggagcauugcucucgcguuucuggccacagggggagugcuugucuuccuggcuacgaaugugcaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11319 - RNA, 2293 nt, Artificial Sequence
  ZIKV (strain NatalRGN) prME-short variant mRNA Design 1 opt
gggagaaagcuuaccaugaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacacaugugcgaugccaccauguccuacgaguguccuaugcucgacgaaggcguggagccggaugacguggauugcugguguaauacaaccucuacaugggucguguaugggaccugccaucacaaaaagggagaagcuagacggagccgcagagccguuacacugcccucccauucuacccggaaacuucaaacgcgcagccagaccuggcuggaguccagagaguacacaaagcaccucauucggguggaaaacuggaucuuucgcaauccuggcuucgcgcuggccgcugccgcuaucgccuggcugcucggcagcucuaccucccagaaagucauuuaucuggugaugauccuucugauugcgcccgccuacagcaucagauguauugggguuucuaaccgggacuuuguggagggaauguccggcgggacaugggucgauguggugcucgaacauggaggcugcgucaccguuauggcucaggacaagccuacgguggauaucgagcuggugacaaccacagucagcaauauggccgaggugcgcucuuacuguuaugaggcuuccauuagcgacauggccuccgauucuagaugccccacccaaggggaagccuaccuugacaagcagagcgacacccaguauguuuguaaacggacacugguggaucgcggauggggcaacggcugcggacucuucgggaagggcucccuggucacgugcgcuaaauuugcguguagcaagaaaaugaccgggaagucuauccagccugaaaaucuggaguacagaaucaugcucuccgugcacggaagccaacacucuggcaugauuguuaacgacacagggcaugaaaccgaugagaaucgggccaagguggagaucacaccgaacagccccagagcugaagccacccugggaggcuucggcucccuugggcuggacugcgagccucgcacgggacucgauuuuucugaccuguauuaccuuacaaugaauaacaaacacuggcugguccauaaggaaugguuccacgauauuccccucccuuggcacgccggcgcugacaccgggacaccccauuggaauaacaaagaggcccugguggaauuuaaggaugcgcacgcuaaacggcagaccgucgugguucugggaagccaggagggcgccgugcauaccgcccucgcuggggcccuggaggcugaaauggacggcgccaagggaagacuuuccagcggccaccugaaaugucgccucaagauggauaagcugcggcuuaaaggggucucuuauucccugugcacagcggccuucacguuuaccaagaucccggcugagacacuccauggaaccgugacaguugaagugcaguacgccggcaccgacgggccuuguaaaguccccgcucaaauggccguggacaugcagacgcugaccccugugggaagacugauuacagcgaaccccguuaucaccgagagcacagaaaauucuaagaugaugcucgagcuggaucccccuuucggcgacuccuacaucgucauuggggugggcgagaaaaagaucacccaccacuggcaucgcagcggauccacgcuuggcaaggccuuuucuacaacccugaaaggggcucagcggcucgccgcucugggagauacagccugggacuucggcagcauugggggaguguucaacuccaucggcagagccguccaccaaguguuugggggcgcuuuccgcacccuguuuggaggcaugucuuggauuacccaggggcuuaugggagcgcuccugcuguggaugggcguuaaugcccgggauagaagcaucgcucucgccuuccuggccacagggggagugcuugucuuucuggcuacgaacgugcaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11320 - RNA, 2320 nt, Artificial Sequence; identical to SEQ ID NO: 11304
  ZIKV (strain ZikaSPH2015) ME variant mRNA Design 1 opt

SEQ ID NO: 11321 - RNA, 2320 nt, Artificial Sequence; identical to SEQ ID NO: 11305
  ZIKV (isolate Z1106033) ME variant mRNA Design 1 opt

SEQ ID NO: 11322 - RNA, 2308 nt, Artificial Sequence; identical to SEQ ID NO: 11306
  ZIKV (strain MR 766) ME variant mRNA Design 1 opt

SEQ ID NO: 11323 - RNA, 2320 nt, Artificial Sequence; identical to SEQ ID NO: 11307
  ZIKV (strain NatalRGN) ME variant mRNA Design 1 opt

SEQ ID NO: 11324 - RNA, 2293 nt, Artificial Sequence; identical to SEQ ID NO: 11308
  ZIKV (strain ZikaSPH2015) ME variant mRNA Design 1 opt

SEQ ID NO: 11325 - RNA, 2293 nt, Artificial Sequence; identical to SEQ ID NO: 11309
  ZIKV (isolate Z1106033) ME variant mRNA Design 1 opt

SEQ ID NO: 11326 - RNA, 2281 nt, Artificial Sequence; identical to SEQ ID NO: 11310
  ZIKV (strain MR 766) ME variant mRNA Design 1 opt

SEQ ID NO: 11327 - RNA, 2293 nt, Artificial Sequence; identical to SEQ ID NO: 11311
  ZIKV (strain NatalRGN) ME variant mRNA Design 1 opt

SEQ ID NO: 11328 - RNA, 2320 nt, Artificial Sequence
  ZIKV (strain ZikaSPH2015) prME-short variant mRNA Design 1 opt
gggagaaagcuuaccaugggaagaaaacaaaacaaaagaggcggcaaugaaggaagcauuaugugguuagcaucacuagcaguaguaauagcaugugcgggcgcaguuacacgcagagguagugcauacuacauguaucuagauagaaaugaugcaggagaagcaauaucauuucccaccacauuaggaaugaauaaauguuauauucaaauaauggaucuaggacauaugugcgaugcaaccaugucauacgaaugccccaugcuagaugaaggaguagaacccgacgacguagauugcuggugcaauacgacuucaacauggguaguauacgggacaugccaucauaagaaaggggaagcccgaagaaguaggagagcaguaacacuaccuucucauucaacuagaaaauuacaaacuagaagucaaacuuggcuugaaucaagagaauauacaaaacaucuaauuagaguugaaaacuggauauucagaaacccagguuucgcauuagcugcugccgcgauagcaugguuauuaggcucaaguacuucacaaaaaguaauuuauuugguuaugauauuauuaauugcuccagcuuacucuauaagauguauaggugucagcaaucgagauuucguugaaggaaugucuggggguacaugggucgacauaguccuagaacaugggggauguguaacagugauggcacaagauaaaccuacaguugacauagaauuagugacaacaacugucucaaauauggcggagguaagauccuacuguuaugaagcaucaaucucagauauggcaagugacagcagaugcccaacccaaggugaagcauaccuugacaaacaaagcgacacccaauauguauguaaacguacauuaguagauagaggguggggaaacggguguggauuauuuggaaagggaagucuaguaacaugugcaaaauucgcauguuccaagaaaaugacaggaaaaucaauacaaccagaaaauuuggaauauagaauaauguuaucaguucacggaucacaacacucgggaaugauuguaaacgauacuggacaugaaacagacgaaaauagagcaaaaguagaaauaacuccaaacucaccgagagcagaagcaacacucggugguuucggaucauuaggauuggauugugaaccaaggaccggacuggacuucucagauuuauacuacuuaacaaugaauaauaaacauuggcugguacauaaagaaugguuccacgacauaccauuaccauggcaugcaggagcagauacaggaacaccacacuggaauaauaaagaagcucuaguugaguuuaaagaugcucaugcaaaaagacaaacagucguuguauuagggagucaagaaggagcgguucauacagcauuagcaggagcauuggaagccgaaauggacggagcaaaaggaagauuaaguucaggccacuuaaaauguagauugaaaauggacaaauuaagacuaaaaggaguaucguauagccuaugcacagcagcauuuacauuuacaaaaauaccagcagaaacccuacaugguacaguaacaguagaaguucaauacgcaggaacagaugguccuuguaaaguuccagcccagauggcaguagauaugcagacauuaacaccagucggcagauuaauaacagccaauccgguaauaacagaaucaacagaaaauagcaaaaugauguuagaacuagacccacccuuuggcgauucauauauaguaauagguguaggagaaaagaaaauaacucaucacuggcaucgaaguggaucaacuauagguaaagcauuugaagcaacaguacgcggagcaaaaagaauggcuguauuaggagauacggccugggacuuugguucaguugguggagcacuaaacucacuaggcaaaggaauacaucaaauuuuuggcgcagcuuucaaaucauuauuuggaggaaugucuugguucucacaaauauuaauaggaacauuauuaaugugguuaggauuaaacacuaaaaauggaucaauaaguuugaugugccuagcuuuaggugguguacuaauauuucuaucaacagcaguuucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11329 - RNA, 2320 nt, Artificial Sequence
  ZIKV (isolate Z1106033) prME-short variant mRNA Design 1 opt
gggagaaagcuuaccaugggacguaaacaaaauaaaagagguggaaaugaaggaaguauuaugugguuggcaagcuuagcaguaguaauagcaugcgcgggggcuguaacuaggaggggaagugcauacuacauguaucuagacagaaacgaugcaggugaagcaauuaguuuuccuacuacauuaggcaugaauaaauguuacauacaaaucauggauuuaggacauacaugugaugcaacuaugaguuaugaauguccuauguuagaugaaggcguugaaccagaugacguagacuguugguguaauacaacaaguacuuggguaguauaugggacgugucaucacaaaaaaggagaagcaagaagaucaagaagagcuguuacacuuccaagucauucgacaagaaaacuacagacaagaucucagacuuggcuagaaagcagagaauauaccaaacauuuaauuagaguagagaauuggauauuuagaaauccaggauucgcauuagcagcagcugcaauagcaugguuauuaggaagcaguacgucacaaaagguaauauaccuaguaaugauauuauuaauagcaccugcauacaguauaagaugcauaggaguaaguaacagagauuuuguagaaggcaugagugguggaacauggguagaugucguacuugagcaugguggguguguaacuguaauggcacaagauaaaccaacaguagacaucgaauuagugacaacaacaguaagcaauauggcagaaguacggucauauuguuacgaagcgaguaucucugacauggcaucagauaguagaugucccacacaaggggaagcuuauuuagauaaacaaucagauacacaauacguauguaaaagaacguuaguggaucgcggauggggaaauggauguggacuauucggcaaaggauccuuaguaacaugugcgaaauucgcaugcucaaaaaaaaugacaggaaaaucaauacaaccagaaaauuuagaauaucguauuaugcuaaguguacauggaucucaacacagcggaaugauaguaaacgauacuggacacgaaacagacgaaaauagggcaaaaguggaaauuacacccaauucaccaagagcagaagcuacuuuaggagguuuuggaaguuuagguuuagacugcgaaccgcguacaggauuagauuuuagugacuuauauuaucugacuaugaauaauaaacauugguuaguucauaaagaaugguuucaugauauaccacuuccuuggcaugcgggagcagacacaggaacaccacacuggaauaauaaagaagcauuagucgaauuuaaagaugcacaugcaaaaaggcaaacaguaguaguacuaggaucacaagaaggagcuguacauacagcacuagcaggagcauuagaagcagaaauggauggugcaaaaggaagacuuagcucuggacauuuaaaaugcaggcuaaaaauggacaaauugagauuaaaaggcguaucauauucguuauguacagccgcguuuaccuuuacaaaaauaccagcagaaacacuacacgguacaguuacaguagaaguacaauacgcaggaacagacggaccuuguaaaguaccagcacaaauggcagucgacaugcagacauuaacaccaguagguagacuaauuacagcaaauccaguaauaacagaaucuacagaaaacucaaaaaugauguuagaauuagaucccccauuuggagauaguuauauuguuauaggaguaggggaaaaaaaaauaacacaucauuggcacaggucagggaguacaauaggaaaagccuuugaggcaaccguaagaggagcaaaaagaauggcaguauuaggagauacagcaugggauuuuggaaguguaggaggagcgcuaaauagucuaggcaaaggaauucaucaaauuuucggagccgcauucaaaucauuauuuggaggaaugagcugguuuucucaaauacuaauugguacuuuauuaaugugguuaggauuaaacgcaaaaaauggaagcauaaguuugaugugcuuagcacuagguggaguauuaauauuucugagcacagcaguaagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11330 - RNA, 2308 nt, Artificial Sequence
  ZIKV (strain MR 766) prME-short variant mRNA Design 1 opt
gggagaaagcuuaccaugggaagaaaacaaaauaaaaggggugguaaugaagguucuaucaugugguuagcaucguuagcaguagugauagcuugugcaggagcuauaacaagacgaggaucagcauacuauauguacuuagacagaagugacgcaggaaaagcaauuucauuugcuaccacauuaggaguaaauaaaugccauguacaaauaauggauuuaggacacaugugugacgcaacaauguccuaugaaugcccuauguuggaugaagguguugaaccagaugauguugauugcugguguaauacgacaaguacuuggguuguuuauggaacaugccaucauaagaaaggagaagcaaggagaucaagacgagcagucacacuaccaucacacucaacaagaaaacuacaaacacgcucacaaacauggcuagaaagcagagaauauacaaaacauuuaauaaaaguggagaauuggaucuuuagaaauccaggguuugcgcuuguagcuguagcaauagcaugguugcuuggaaguucuacaagccaaaaaguuauauaucuaguaaugauauuauugauagcaccagcguauucaauaagauguauuggaguaagcaauagagauuuuguagaaggcaugucaggaggaacauggguagacguaguucucgaacauggaggcuguguaacaguaauggcacaagauaaaccuacgguggacauagaguuaguaacaacaacaguauccaauauggcugagguucgaucauauugcuacgaagcaagcauaucagacauggccagcgauucaagauguccaacucaaggggaagcauaucuugauaaacaaagcgacacgcaauacguauguaaaagaacucuaguagauaggggauggggaaaugguuguggauuauuuggaaaaggaucauuaguaacaugugcuaaauuuacauguucaaagaaaaugacaggaaaaaguauacaaccugaaaauuuggaauacagaauaauguuaagcguacauggaagccaacauucaggaaugaucggauaugaaacagaugaagauagagccaaaguagaagugacaccaaauucaccuagagccgaagcgacacuugggggauucggaagucuaggauuagacugugaaccuagaacaggacuagauuuuagcgaccuauauuauuuaacaaugaacaacaaacauuggcuaguacauaaagaaugguuccaugauauaccauuaccauggcacgcaggagcagauacuggaaccccacacuggaauaauaaagaggcccugguagaguucaaagacgcucaugcaaaaagacaaacaguggucguuuuaggaucacaagaaggagcgguacauacugcccuagcuggagcucuagaagcagaaauggauggagcuaaaggaagguuauuuucgggacauuuaaaauguagacuaaaaauggauaaauuacgacuaaaggguguauccuauaguuuauguacagccgcuuuuacauuuacuaagguuccggcagaaacauuacacgggacuguaacaguagaaguacaauaugcgggaacagauggaccguguaaaaucccgguucaaauggcaguagauaugcaaacauuaacaccaguuggaagauuaauaacagcuaacccagugauaacagaaaguacagaaaacagcaaaaugauguuagaauuagauccaccauuuggagauaguuauauaguuauaggaguaggagauaagaaaauaacacaccauuggcauagaucugguagcacaauaggaaaagcauuugaagcaaccguucgaggagcaaaaagaauggcaguauuaggagauacugcaugggauuuugggagcguaggaggaguauuuaacucauuaggaaaaggaauacaucaaauauuuggagcagcauucaaaucgcuauuuggaggaaugaguugguuuagccaaauacuaauugggacucuauuaguaugguuaggacuaaauaccaaaaauggaagcauaaguuuaacaugccuagcauugggaggaguaaugauauuuuuaagcacagccguuucagccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11331 - RNA, 2320 nt, Artificial Sequence
  ZIKV (strain NatalRGN) prME-short variant mRNA Design 1 opt
gggagaaagcuuaccauggguagaaaacaaaacaaaagagguggaaaugaaggaucaauaaugugguuagcuucacuagcagucguaaucgcuugugcaggagcuguaacuagaagaggaagugcauauuauauguaccuagauagaaaugaugcaggagaagcuauuaguuuuccaacaacacuagguaugaauaaaugcuauauacaaaucauggaucuaggacauaugugugaugcaaccaugucauaugaauguccuaugcuugaugaagguguugagccggaugacguggauuguugguguaauacuacgaguacauggguaguguauggaacaugucaucauaaaaaaggagaagcccgccgaaguagaagggcaguaacgcuaccaagucauucuacaaggaaacuacaaacaagaucacaaacaugguuggaaucacgagaauauacgaagcaucuuauuagaguugaaaauuggauuuucaggaauccaggauucgcuuuagcggcggcagcaauagcuuggcuacuaggaaguaguacuucacaaaaaguaauauauuuaguaaugauacuauugaucgcaccggcauacucaauaagauguauaggaguuucaaauagagacuuuguagaaggaaugagcgguggcaccuggguugauguuguauuggaacacggaggaugcguaacagucauggcacaagauaaaccaacaguagauauagaauuaguaacaacaaccguaaguaauauggcagaaguacgaucauauuguuaugaggcaaguauaucugauauggcuucagacucacguuguccaacucaaggcgaagcauaccuagauaaacaaucagauacucaauacguaugcaaaagaacauuaguagauagaggguggggaaaugguuguggauuauucggaaaaggaucauuaguaacuugugcaaaauucgcaugcaguaaaaaaaugacaggaaaaaguauacaaccagaaaauuuagaauacagaauaauguuaaguguacacggaagccaacauaguggaaugauuguaaaugauacuggacaugaaacggacgaaaaccgugcuaaaguagagauaacaccaaauagcccgagagcagaggcaacauuagguggauuugguaguuuagguuuagacugcgaaccucguaccggguuagacuuuagugacuuauauuauuuaacaaugaauaacaaacauugguuagugcauaaagagugguuccacgauauaccucucccuuggcaugccggagcugacaccggaacaccacauuggaacaauaaagaagcauuaguagaauuuaaagacgcacacgcaaaaagacaaacaguaguuguauuaggaucacaagagggugccguacauacagcacuugccggagcauuagaagcugaaauggauggagcuaaagguagacuuucaucaggacauuuaaaauguagauuaaaaauggauaaauuaagacucaaaggagucucauacagucuuuguacagcugcauuuaccuuuaccaaaauuccagcagagacacuacauggaacaguaacuguagagguacaauaugcaggaacagauggaccauguaaaguaccugcacaaauggcaguagauaugcaaaccuuaacaccaguaggaagauuaauuacagcuaaucccguaauaacugaaaguacagaaaacaguaaaaugauguuagaauuagauccaccauuuggugauagcuauauaguuauaggaguaggcgaaaaaaaaauaacucaucauuggcauagaagcgguagcacaauuggaaaagcauuugaagcaacuguaagaggagcaaaaagaauggcuguacuaggagauacagcaugggauuuuggaagcguuggaggagcacuaaauucauuaggcaaaggaauacaucaaauauuuggagcagcauucaaaagcuuauucggaggaaugucaugguuuucgcaaaucuuaauaggaacuuuacuaaugugguuaggacuaaauacuaaaaacggaucuauuagcuuaaugugcuuagcacuaggaggaguguuaauuuucuugucaacagcuguaagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11332 - RNA, 2293 nt, Artificial Sequence
  ZIKV (strain ZikaSPH2015) prME-short variant mRNA Design 1 opt
gggagaaagcuuaccaugaaugaaggaucuauaauguggcuagcuagucuugcugucguuauugcaugugcaggagcaguaacgcgaagagguucagcauauuacauguauuuagauagaaaugaugcgggagaagcaauaucauuuccaacuacauuaggaaugaacaaauguuauauccaaaucauggauuuaggccauaugugugaugcuacaaugucauaugaaugcccuaugcucgaugaaggaguagaaccagaugauguagauuguugguguaauacaacaagcacauggguuguauauggaacaugucaucacaaaaaaggagaagcgcgaagaucacgaagggcuguaacauuaccgucacauucaacacgaaaauugcaaacaagaagucaaacauggcuagaaucccgugaauauacaaaacauuuaauaagaguagaaaauuggauauucagaaauccagguuucgcauuagcagcggcugcaauagcaugguuauuagguaguagcacaagucaaaaaguaaucuaucuaguaaugauacuucuaauagcaccugcauauucaauaagaugcauaggcguuagcaauagagacuucguagaagggaugucagguggcacguggguagacauagugcuagaacauggaggauguguaacagucauggcccaagauaaaccuacaguagauauugaacuaguuacaacuacaguuucaaauauggcugaaguaagaucauauuguuacgaagcaaguauuucagauauggcaucagauaguagaugcccaacacaaggugaagcauaccucgauaaacaaagcgacacgcaauauguauguaaaagaacccuaguugacagagguuggggaaacggaugcggauuauuugggaaagguucacuaguaacaugcgcaaaauuugcaugcucaaaaaaaaugacaggcaaaucaauacaacccgaaaaucuagaauacagaauuauguuaucaguccauggaagucaacauucaggaaugauagucaaugauacaggacaugaaacagaugaaaacagggcaaaaguagagauaacuccaaacucaccuagggcagaagcaacuuugggagguuucggaagcuuaggauuagacugcgaaccuagaacagguuuagauuuuagcgacuuauacuaucuuacaaugaacaauaagcacugguugguacauaaagagugguuucacgacauaccuuuaccauggcacgcaggugcagacacaggaacaccucauuggaauaauaaagaagcauuaguagaauuuaaagaugcacaugcaaaacgucaaacgguagucguacuaggcucccaagaaggagcgguacauaccgcacuugcaggcgcauuagaagcagaaauggauggagcaaaaggaagacuaagcucaggucaucuaaaauguagauugaagauggauaaauuaagauuaaaagggguuaguuacucguuauguacagcagcauuuacauucacaaaaauaccagcggaaaccuuacacggcacuguaacggucgaaguucaguaugcaggaacugaugguccauguaaaguaccagcacaaauggcaguagauaugcaaacauuaacaccuguaggaagguuaauuacugccaacccaguaauaacagaaaguacagagaauucaaaaaugaugcuagaacuagauccuccguucggagacaguuauauaguaauaggaguaggagaaaaaaaaauuacacaucauuggcauagaaguggaucaacaauaggcaaagcauucgaagcuacaguuagaggugcaaaaagaauggcaguacuaggcgacacagcaugggacuuuggaucaguugggggagcucuaaacagcuuaggaaaaggcauacaccaaauauucggagccgcuuuuaaaagucuguuuggaggcaugagcugguuuucacaaauucuuauaggaacauuguuaaugugguuaggauuaaauacgaaaaauggaucaauaucauuaaugugcuuagcacucggaggcguauuaauuuuuuuaucgacagccguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11333 - RNA, 2293 nt, Artificial Sequence
  ZIKV (isolate Z1106033) prME-short variant mRNA Design 1 opt
gggagaaagcuuaccaugaaugaaggaaguauaaugugguuagcuagucuugcaguaguaauagcuugcgcaggagccguaacaagaaggggaagugcauauuauauguacuuagauagaaacgaugcuggagaagcaauaaguuuuccaacaacauuaggaaugaacaaauguuauauacaaauaauggacuuaggucauacaugugaugcaacaauguccuaugaauguccuaugcuugacgaaggaguagaaccagaugauguagacuguugguguaacacaaccucuacauggguaguuuacgguaccugucaucauaaaaaaggggaagcaagaagaagccgucgugcaguuacacucccaagccacagcacuagaaaauuacaaacaagaagucaaacuugguuagaaucaagggaauacacaaaacacuuaauuagaguggaaaauuggauauucagaaauccuggauuugcucuggccgcugcagcaauagcuuggcuauuaggaucaagcacuagucaaaaaguuauauaucuaguaaugauauuacucauagcaccagcauauucaauaagauguauagguguaucaaacagggacuucguagaaggaaugagugguggaacauggguagauguaguacuagaacacggaggcugcgucacaguaauggcucaagauaaaccaacaguagauauagaacucguuacgacaacaguaaguaauauggcagaaguuagaaguuauuguuaugaagcaucaauaagugauauggcaagugacagcagaugcccaacacagggugaagcauaucuagacaaacaaucugauacacaauauguuugcaaaaggacauuaguugauagaggaugggguaauggauguggauuauuugguaaaggaaguuugguaaccugcgcaaaauucgcuuguucgaaaaaaaugaccggaaagucaauacagcccgaaaaccuagaauauagaauaaugcuuucaguacacggaucacagcauaguggcaugauagugaaugacacaggucaugaaacagacgaaaauagagcaaaaguagaaaucacaccaaauucaccacgagcugaagcaaccuugggaggauuuggcagcuuaggacuagauugugaaccaagaacuggauuagauuuuucagaucuauauuacuuaacaaugaacaacaaacauugguuagugcacaaagaaugguuucacgacaucccacuacccuggcacgcuggugcagacacagggacuccucauuggaacaacaaagaagcauuaguagaauuuaaagaugcucaugcaaaaagacaaaccguuguaguccuuggaagucaagaaggcgccguacacacagcauuagcuggagcacuagaagcggaaauggauggagcaaaaggaagacuaucaucaggacaucuaaaauguagauuaaaaauggauaaauuaagacuaaaagguguaaguuacaguuuauguacagcugcauuuaccuucacuaaaauucccgcagaaacacuccacggaacaguaacaguagaagugcaauacgcuggaacagauggaccauguaaaguaccugcacaaauggccguagacaugcaaacauuaaccccaguaggcagauugaucacagcuaacccaguaauaacugaaagcacagaaaauagcaaaaugauguuagaacuugauccuccguuuggcgauaguuauaucguaauagggguaggagaaaaaaaaauuacacaucauuggcauagaaguggaaguacaauaggaaaagcauuugaagcaacuguaagaggugcaaaaagaauggcaguauuaggugauacagcgugggauuuuggaucaguuggaggagcauuaaauaguuuaggaaaagguauacaucaaauauuuggagcugcguucaagucacuauuuggaggaaugaguugguuuagccaaauacuaauagguacgcuacuaaugugguugggcuuaaacgcaaaaaacggaaguauuucacuaauguguuuagcacuaggaggagugcuuauauuucuuaguacagcaguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11334 - RNA, 2281 nt, Artificial Sequence
  ZIKV (strain MR 766) prME-short variant mRNA Design 1 opt
gggagaaagcuuaccaugaaugaaggaucuauuaugugguuagcaucacuagcggugguaaucgcaugcgccggcgcaaucacaagaagaggaucagcauauuauauguaccucgaucgaucagaugcuggaaaagcaauaucauucgcaacaacauuaggaguuaauaaaugccauguacaaauuauggacuuaggacauaugugcgaugcaacuaugucauaugaauguccaaugcuagaugaaggaguggaaccagaugauguagauuguugguguaacacaacaagcacauggguaguuuacggaacuugucaucauaagaaaggagaagcgcgacgaucaaggagagcaguuacacuaccaagucacaguaccagaaaacuacagacaagaucacaaacaugguuagagaguagagaauauacgaaacaccucauaaaaguagaaaauuggauauucagaaauccaggauuugcucuaguugcagucgcaauagcaugguuauuaggaucaaguacgagucaaaaaguaauauacuuaguaaugauauuacuaauagcaccagcauauucuauuagaugcaucggaguuucaaauagagauuucgucgagggaaugucaggaggaacuuggguagaugugguauuagaacacggaggaugcguaacaguaauggcacaagacaaaccaacagucgauauagaauuagugacaacaacaguaagcaauauggcagaaguaagaucauauuguuaugaagccucaauaagcgauauggcgucagauucaagaugcccaacacaaggagaagcauacuuagacaaacaaucugacacacaauaugucugcaaaagaacucuagucgacaggggcugggguaacggaugcggauuauucgguaaaggaucauuaguaacaugugcaaaauucacauguaguaagaaaaugacuggcaaaagcauucaaccagaaaaucuagaauacaggauaaugcuaucaguacacggaagccaacacagcggaaugauaggauacgaaacagaugaagauagagcaaaaguagaaguaacaccgaacaguccacgagcugaagcgacauugggcggguucggaucauuaggauuagauugugaaccgagaacagguuuagauuuuagcgaccuguauuacuuaacaaugaauaauaaacauuggcuaguacauaaagaaugguuccaugauauaccacugccauggcaugcaggggcagauacagguacaccacacuggaauaacaaagaagcauugguagaauuuaaagaugcacaugccaaacgacaaacgguagugguauuagggucacaagagggagcuguacauacagcauuagcaggagcacuggaagccgaaauggauggugcaaaaggaagauuguucaguggacaucuaaaaugcagauugaaaauggauaaacuacgauuaaaagggguaucauauucacuauguacagcagcauuuacauuuacaaaagugccagccgaaacuuugcaugguacaguaacaguagaaguacaauaugcagguacagauggaccauguaaaauaccuguucagauggcagucgacaugcaaacacuuacaccuguuggaaggcuuauaacagcaaauccagugauaacagaaucaacagaaaauagcaaaaugaugcuagaacuagauccacccuuuggagauucauacauaguaauuggggucggagauaagaaaauaacucaucauuggcauagaucuggaagcacuauaggaaaggcuuucgaagcaacaguaagaggagcaaaaagaauggcaguauuaggagauacagcaugggauuuuggaagcguagguggaguauuuaauucguuaggaaaaggaauccaucaaauuuuuggagcagcauucaaaagucuauuuggagguaugucuugguuuagccaaauauuaauagguacauuacuuguauggcuaggacuaaauacuaaaaacgggucuauaaguuuaacaugcuuagcacuaggagggguaaugauauuuuuaagcacagcaguaagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11335 - RNA, 2293 nt, Artificial Sequence
  ZIKV (strain NatalRGN) prME-short variant mRNA Design 1 opt
gggagaaagcuuaccaugaaugaaggaucaauaauguggcuagccaguuuagcgguaguaaucgcaugugcuggagcaguaacaagaagaggaagcgcuuacuauauguauuuagacaggaacgaugcaggugaagccauaaguuuucccacaacacuaggaaugaacaaauguuauauucaaauaauggaucuaggacauaugugugaugcuacuaugaguuaugagugcccaaugcuagacgagggaguggaaccugaugacguagacugcuggugcaauacaacaagcacauggguaguuuauggaacaugucaccauaaaaaaggagaagcucggcgaucaagaagagcaguaacauuaccuagucauaguacgagaaaacuacaaacaaggagccaaacaugguuagaaucacgugaauacacaaaacauuuaauaagaguagagaacuggauauuuagaaacccaggcuuugcacuagcagcagcagcaauagcaugguuauuaggaucaucgacaagccaaaaaguaauauaucuagugaugauauuacuaaucgcaccagcauauagcauaagauguauaggaguuagcaauagagacuucguagaaggaaugucaggcggaacauggguagauguaguuuuagaacauggaggauguguaacaguaauggcucaagacaaaccaacagucgauauugaacuaguaaccacgacaguaagcaacauggcugaaguacgaucauauuguuaugaggcaagcauauccgacauggcaucggacucaagauguccaacacaaggugaagcauauuuggauaaacaaucagauacacaauauguguguaaaagaacuuuaguugaucgcggaugggguaacggaugugguuuauuuggaaaaggaucacuaguuacaugugcaaaauucgcaugcaguaaaaaaaugacgggaaaaagcauacaaccggaaaaucuagaauauagaauaauguugaguguacauggaucacaacauaguggaaugauaguaaaugauacaggccacgaaacagaugaaaauagagcaaaaguugaaauuacaccaaauagcccacgagcagaagcaacacuagggggauucggaagucuaggguuagacugcgaaccaagaacggguuuggauuuuagugaucuauauuaucuuaccaugaauaacaaacauuggcucguacauaaagaaugguuucaugauauaccauuacccuggcaugcaggagcagauaccgguacgccucauuggaauaauaaagaagcauugguagaauucaaggaugcacacgcgaaaaggcaaacuguaguaguauuaggaagccaagaaggagcaguacacacagcauuagcuggugcacuagaagcugaaauggauggagcaaaaggaagauuaaguucaggucauuuaaaauguagauuaaagauggauaaauuaagauuaaaagggguaaguuacucauuauguacugcggcauuuacauuuacaaaaauaccagcagagacucuacaugguacaguaacaguugaagugcaauaugcagguaccgauggaccauguaaaguaccagcacaaauggcaguugauaugcaaacacuuacaccagucgggagacuaauaacugcaaacccaguaauaacagaaucaacagaaaacaguaaaaugaugcuagaauuagauccaccauuuggagacaguuauauaguaauaggaguaggugaaaaaaaaauuacacaccacuggcacagaucaggaaguacgauaggaaaagccuuugaagcgacagugagaggagcaaaaagaauggcaguauuaggagacacagcaugggauuuugguaguguuggaggcgcucuaaauucacuagguaaaggaauacaucaaauauuuggagcagcauuuaaaagccuauuuggagggaugucaugguucagucaaauucuaauaggaacacuauuaaugugguuaggacuaaauacaaaaaacggaucaauaucuuuaaugugucuagcauuaggaggcguauuaauauuucuuagcacagcgguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11336 - RNA, 2320 nt, Artificial Sequence
  ZIKV (strain ZikaSPH2015) prME-short variant mRNA Design 1 opt
gggagaaagcuuaccaugggaaggaaacaaaauaaaagaggugguaaugaaggaucaauaaugugguuagcaucacuagcagucgucauagcuugcgcgggagcaguaacuagaagaggaucggcuuacuacauguauuuagauagaaaugaugcaggagaagcuauaucuuucccgacaacacucggaaugaauaaauguuauauccaaauuauggaucuuggacauaugugcgaugcaacaaugagcuaugaauguccaauguuagaugaggguguugaaccggaugauguagauuguuggugcaauacaacaucaacauggguaguauacggaacaugucaccauaagaaaggagaagcuagaagaagcagacgagcaguaacacuaccaagucacucaacaagaaaauuacaaaccagaagucaaacuugguuagaaagucgagaauauacaaaacaucuuauacggguagaaaauuggauauuuagaaauccuggauucgcacuugcagcggcagccauagccuggcuauugggcagcaguacaagccaaaaaguaauuuaucuuguaaugauauuauuaauagcuccagcauauagcauuagauguauaggaguaagcaacagagauuuuguagaaggaaugucaggaggaacauggguugauauaguauuagaacacggugguuguguaacaguaauggcacaagauaaaccuacaguagacauugaacuuguaaccacaacaguuaguaauauggcagaaguaagaucauacuguuaugaagcuaguauaucagauauggcaagugacucaagauguccaacacaaggagaagcauauuuagacaaacaaucagauacacaauacgugugcaaaagaacauugguagacagaggaugggggaauggauguggauuauucggaaaaggaucauuaguaaccugugcaaaauuugcauguaguaagaaaaugacagguaaaucaauacaaccugaaaaucuagaauauagaauaaugcuauccguacacggcagccaacacuccggaaugauaguaaaugacacuggacaugagacugaugaaaaucgagcaaaaguagaaauaacaccuaauagccccagagcagaagcaacauugggaggauuugguagcuuaggauuagacugcgaaccuagaacuggcuuagauuuuuccgacuuauauuauuuaacaaugaauaauaaacauugguuaguacauaaagagugguuucaugacauaccacuaccguggcacgcaggagcagauacaggaacuccacauuggaacaauaaagaagcccuaguagaauuuaaggacgcacaugcaaaaagacaaacaguaguaguuuuggggucacaagaaggagcaguacauacagcauuagcaggcgcacuagaagcugaaauggauggcgcaaaaggacgauugagcucaggucauuuaaaaugcagacuuaaaauggauaaauuaagacugaaaggggugucuuauucgcuauguacagcugcauuuacauucacaaaaauaccagccgaaacauuacacggaacagucacaguagaaguucaguaugcuggaacugacggcccauguaaaguuccagcacaaauggcaguagauaugcaaaccuuaacaccuguaggaagguuaauuacagcaaauccaguaauaacagaaucaacagaaaauaguaaaaugauguuagaauuagacccaccuuuuggagauaguuacauaguaauuggagucggagagaagaaaauuacacaucacuggcacagaagcggaagcacauuaggaaaagcauuuagcacaacguuaaaaggagcacaaagauuagcugcauuaggagauacagcaugggauuucggaucaaucggaggaguuuucaauaguauagggagagcaguacaccaaguauucggaggagcauucagaacacuauucggaggaaugaguuggauaacacaagguuuaaugggagcacuacuauuauggaugggcguaaacgcccgcgaccgaucuaucgcauuagcauucuuagcaaccggcggcguacuuguuuuccuagcaacaaacguacaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11337 - RNA, 2320 nt, Artificial Sequence
  ZIKV (isolate Z1106033) prME-short variant mRNA Design 1 opt
gggagaaagcuuaccaugggaagaaaacaaaauaaaaggggagguaaugaaggaucaauaaugugguuagcaaguuuagcuguaguaauagcaugugcaggagcaguaacaagaagagguagcgcauacuacauguauuuagacagaaacgaugcaggagaagcaauuuccuuccccacaacuuuaggaaugaauaaauguuauauacaaauaauggauuuaggacacacaugugaugcuaccaugucauaugaaugucccaugcuagaugaaggaguagaaccagacgacguugauuguugguguaauacaacaaguacuuggguuguauaugggacaugucaucauaagaaaggcgaagcucgaaggucaagacgagccguaacauugccgagucauucaacaagaaaauuacaaacgagaucacaaacauggcucgaaucaagagaauacacaaaacacuuaauaagaguugagaacuggauauucagaaauccugguuuugcauuagcagcagcugccauagcauggcuauuaggaaguagcacaucucaaaaaguuauauacuugguaaugauucuauuaauagcuccagcauauucuauaagauguauaggaguuaguaaccgagacuuuguagaaggaaugagcggaggaacguggguagacguaguauuagaacauggaggaugcguaacaguaauggcacaagauaaaccaacagucgauauagaauuaguaacaacaacaguaucaaauauggcggaaguaaggaguuauuguuaugaagcaucaauaagugacauggcaagugauaguagaugucccacacaaggugaagcguauuuagauaaacaaagugauacacaauauguuugcaaaaggacauuaguagauaggggauggggaaacgguuguggauuauuugguaaaggaagucugguaacaugugcaaaauucgcuugcucaaagaaaaugacaggaaaaucuauacaaccagaaaauuuagaauacagaauaauguuaagcguacauggaagucaacacucaggaaugauagucaaugauacaggucaugaaacagaugaaaacagagcaaaaguagaaauuacaccaaauucaccgagagcagaagcgacauuagguggauucgggaguuuaggccuagacugugagccccgaacaggucuagauuuuucagauuuguauuaccuaaccaugaauaauaaacacuggcugguacauaaagaaugguuccacgauauaccacuuccauggcaugcaggagcagacacaggaacaccacauuggaauaacaaagaagcauuaguggaguucaaagacgcucaugcuaaaaggcaaacuguuguuguuuuaggaagucaagaaggagcuguacacacggcacuagcgggugcauuagaagcagaaauggauggagcaaaagguagacuaucaucaggacacuuaaaaugccgguuaaaaauggauaaacuaagauuaaaaggagucaguuauucauuaugcacugcagcuuuuacauucacuaaaauuccggcagaaacacuacauggaacagucaccguagaaguacaauaugccggaacagauggacccuguaagguuccggcacaaauggcaguagauaugcaaaccuugaccccaguaggaagauuaauaacagcaaacccaguaauaacggaaaguacagaaaauucaaagaugaugcucgaauuggauccaccauuuggagauucauauauaguuauuggaguuggagaaaagaaaauuacacaccauuggcauagaaguggaucaacauuaggaaaagcauuuucgacaacauuaaaaggagcacaaaggcuagcagcauuaggagauacagcaugggauuuuggcaguauugguggaguguuuaauucgauaggcagagcaguucaucaaguauuuggaggagcauucagaacauuguucggaggaaugaguuggaucacccaaggauuaaugggagcauuacuacuauggaugggagucaaugcaagagauagaagcauagcauuggcuuuucuggcuacaggaggaguucuaguauuuuuagcaacaaacguacaugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11338 - RNA, 2308 nt, Artificial Sequence
  ZIKV (strain MR 766) prME-short variant mRNA Design 1 opt
gggagaaagcuuaccaugggacguaaacaaaauaaacgaggaggaaacgaagguucaauaauguggcucgcaagucuagcaguaguaauagcaugugcaggagcaauaacaagaaggggaucugcauacuacauguauuuagacagaucagacgcaggaaaagcaauaaguuuugcuacaacauuaggaguaaauaaaugucacguacaaauaauggaccuaggacacaugugugaugcuacaaugucauaugaauguccuaugcucgaugaaggaguagaaccugaugacguggauuguuggugcaacaccacaagcacauggguaguauacggaacaugucaucacaaaaaaggagaagccagaagaagcagaagggcaguuacauugccgagucauuccacaaggaaauuacaaacaagaucacagacuugguuagaaaguagagaauacacaaaacauuugauaaaagucgaaaauuggauuuuccgaaauccaggauuugcauuaguagcaguagcaauagcaugguuauugggaagcagcacaagucaaaaaguaauauaccuuguuaugauacuacuaauagcuccagcuuacucuauacgauguauugguguaagcaauagagauuuuguagaaggaaugucaggaggaacauggguagacgugguacuagaacauggaggcuguguaacgguaauggcacaagauaaaccgacaguagauauagaauuaguaacaacaacugugaguaauauggcagagguaagaaguuauugcuaugaagcaucuauaagcgacauggcaucagauucgagaugccccacacaaggagaagcuuauuuagacaaacaaucagacacacaauacgucuguaaacggacgcuagucgacagggguugggguaaugguugcggucuauuuggcaaaggaucauuaguaacaugugcuaaauuuacuuguucuaaaaaaaugacaggaaaauccauucaaccagaaaauuuagaauauagaauaaugcuaucaguacaugguagucaacauaguggaaugauaggauaugagacugaugaagauagagcuaaaguugaaguaacaccgaacaguccacgagcagaggcaacacuaggaggauuuggaucauuaggacucgauugugaaccaagaacaggauuagauuuuucagaucuauauuacuuaacaaugaauaauaaacauugguuaguacauaaagaaugguuucaugauauaccacuaccuuggcaugcgggagcagacacgggaacuccacacuggaauaacaaagaagcacuuguagaauucaaagacgcacaugcaaaacgacaaacagugguaguauuaggaucacaagagggugcaguacauacagcuuuagcaggagcacuagaagcagaaauggacggugcaaaagguagauuauucucuggucacuuaaaaugcagauuaaaaauggauaaauuaagauuaaaaggaguuaguuauucauuauguacagcggcauuuacauuuacuaaaguaccagcugaaacauuacacgguacagucacaguugaaguacaauaugcaggaacugauggcccuuguaaaauaccaguacagauggcaguagauaugcaaacauugacaccaguaggacgcuuaauuacagcaaauccaguuauuaccgaaucaacagagaauucaaaaaugauguuagaauuagauccucccuuuggagauagcuauauuguuauaggcguaggugauaaaaaaauaacacaucauuggcaucgaucaggaaguacuuuaggaaaagcauucucaacaacuuuaaaaggagcacaaagguuagcagcacuaggcgauacugcaugggacuucggaucuauaggagguguauuuaauagcaucggcagggcaguacaucaaguauuuggaggagcuuuuagaacacuauucggggguaugaguuggauaacacaaggacuaaugggcgcauuacuauuauggaugggaguaaaugcuagagaucguucaauagcacuagcauuuuuagcuacagggggaguauuaguauuuuuagcaacuaauguacacgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11339 - RNA, 2320 nt, Artificial Sequence
  ZIKV (strain NatalRGN) prME-short variant mRNA Design 1 opt
gggagaaagcuuaccaugggccggaaacaaaauaaaagagggggaaaugaaggaucgauaauguggcuagccucauuagcaguuguaauagcaugcgccggugcgguaacacgaagaggaagugcuuacuauauguaccuagaccgaaaugaugcgggagaagcuauuaguuuuccaacaacacugggaaugaauaaauguuacauacaaauaauggaccuaggacacaugugcgaugcuacaaugaguuaugaauguccaauguuagaugaggguguagaaccagaugacguagauuguugguguaauacaacaaguacauggguaguauauggaacaugucaucacaagaaaggcgaagcaagaagaucaagacgagcaguaacauuaccaucacauucuaccagaaaauuacaaacaaggagucaaacuuggcuagagucuagagaauauacgaaacaucuaauacgaguagaaaauuggauauuuagaaauccaggauucgcauuagcagcugcagcgauagcauggcuacucggauccucaacaucacaaaaaguaauuuacuuagugaugauacuauuaauagcaccagcauauagcauuagguguauaggaguaagcaauagagauuuuguagaaggaaugaguggaggaacaugggucgacguaguauuagaacauggcggauguguaacaguaauggcacaagauaaaccaacaguagauauagaauuaguaacuacaacaguuucaaauauggcagaaguacgaucuuacugcuaugaagcaaguauuucugauauggccucagacaguagaugccccacccaaggugaagccuaucuggauaaacaaucagauacccaguacgucuguaaaagaacccuaguagauagaggauggggaaauggauguggauuauucggaaaagggaguuuaguaacaugugcaaaauuugcaugcucaaagaaaaugacuggaaaaucaauacaaccugagaacuuagaguacagaauaauguuaaguguccauggaucacaacauagugguaugauugugaaugacacaggucaugaaacagaugaaaaucgagcaaaaguagaaauaacaccaaauucaccaagagcagaggcuacauuaggagguuuuggaucguuaggacuagacugcgaaccaagaacaggacuagacuuuagugaucuauacuaucuuacuaugaacaauaaacauuggcuaguucacaaagaaugguuucaugacaucccccuacccuggcaugcaggagcugauacaggaacaccacauuggaauaauaaagaagcguuaguugaauuuaaagaugcacacgcaaaacgacaaacaguggugguauuaggaucccaagagggagcuguacauacagcacuugcaggagcacuagaagcagaaauggauggagcaaaaggaagguuaagcaguggccauuuaaaauguagacuaaaaauggauaaauuaagauuaaaagguguaucauauagcuuauguacagcagcauucacuuuuacaaaaauacccgcagaaacccuucacggaacagucaccguggaaguacaauacgcaggaacugacggaccauguaaaguaccugcucaaauggcuguagauaugcaaacucuaaccccaguuggaagauuaauuacagcaaauccaguuauaacagagucaacagaaaauucaaaaaugaugcuagaauuagauccaccauuuggugauaguuacauagugauaggaguaggagaaaagaaaauaacgcaucauuggcauagaucgggaucaacacuuggaaaagcauuuaguacaacccuaaaaggagcacaaagauuagcagcauuaggggauacugcaugggacuucgguagcauaggagguguauucaauagcauaggcagagcaguacaccaaguauucggaggagcauucagaacauuauucggaggaaugucauggauaacacaaggauuaaugggagcauuauuauuguggaugggaguaaacgcaagagacagaagcauagcauuagcauuccuagcaacaggaggaguuuuaguuuuccuggcaacaaacguacaugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11340 - RNA, 2293 nt, Artificial Sequence
  ZIKV (strain ZikaSPH2015) prME-short variant mRNA Design 1 opt
gggagaaagcuuaccaugaaugaaggauccauaaugugguuagccaguuuagcuguaguaaucgccugcgcuggagcaguuacacggcgaggaucagcauauuauauguauuuagacagaaacgaugcuggagaagcaauaucauuuccaacaacacuaggaaugaauaaauguuauauacaaauaauggauuugggacauaugugugacgcaacaaugaguuaugaauguccaauguuagaugaaggagucgaaccagaugauguagacugcugguguaauacaacaucaacauggguuguuuauggaacaugucaccauaagaaaggagaggcaagaagaaguaggagagcaguaacucuuccaagucacucaacucgaaaacuacaaacacgaucacaaacaugguuagaaucuagagaauauacuaaacauuugauaagaguagaaaacuggauauucagaaaucccggauuugcacuagcagcagccgcaauagcaugguuacuaggaucaaguacuucacaaaaaguaauauauuugguuaugauucuguuaaucgcuccagcauauaguauaagauguauaggagucagcaacagagauuuugucgaagguaugucaggagguacauggguugacaucguacuagaacacggcgguuguguaacgguaauggcacaagauaaaccaacaguagauauagagcuaguaaccacaacaguaucaaauauggcugaagugaggucauauuguuaugaagcaucuauuagugauauggcaucagauagucgauguccuacacaaggagaagcauauuuagauaaacaaucagacacacaauacguuuguaaaagaacucuaguagacagaggauggggaaacggauguggacuauuuggaaaaggcagccuaguaacaugcgcaaaauuugcaugcucaaagaaaaugacuggaaaaucaauacaaccagaaaauuuagaauaucgcauaaugcuuagcguacaugggucacaacacucaggaaugauaguaaacgacacuggacaugaaacugacgaaaacagagcaaaaguggaaauaacaccuaauaguccaagagcagaagcuacucuaggaggauucggaagucuaggcuuagauugugaaccuagaacgggacuagacuucucugaucuauauuacuuaacaaugaauaacaaacacuggcuuguucauaaagaaugguuucacgauaucccauuaccauggcaugcaggagcagauacaggaacaccacauuggaauaacaaagaagcauuaguagaauuuaaggaugcacaugcuaaaagacaaacaguaguaguacuggguucacaagaaggagcaguccacaccgcauuagcaggagcuuuagaagcagaaauggauggagcaaaaggacgacucucaucuggacaucuuaaaugcagacuuaagauggauaaacuaaggcuaaaaggaguaaguuauucauuauguacagcugcauuuacauuuacaaaaauacccgcagaaacauuacauggaacagugacuguagaaguacaauaugcaggcacagaugguccguguaaggucccugcacaaauggcaguugauaugcaaacauuaacaccagucgguagacuaauaacagcaaaucccguaauaacugaaucaacugaaaauucaaaaaugauguuggaauuagauccacccuucggagacucauacauuguaauaggagucggugagaagaaaauaacucaccauuggcacagaaguggaagcacacuagguaaagcauuuucaacaacauuaaaaggcgcacaaaggcuagccgcacuuggugacaccgcgugggauuuuggcucaauagguggaguauuuaauaguauaggucgugcuguacaccaaguauuuggaggcgcauuucgaacucuauuugguggaauguccuggauaacucagggacuaaugggagcacuacuacucuggaugggaguuaaugcaagagauaggucaauagcuuuagcguuucuagcaacaggugguguacucguauuccuggcaacaaacguacaugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11341 - RNA, 2293 nt, Artificial Sequence
  ZIKV (isolate Z1106033) prME-short variant mRNA Design 1 opt
gggagaaagcuuaccaugaaugaagguaguauaaugugguuagcaaguuuagcaguaguaauugccugugcaggagcaguaacaaggagaggaagugcauauuauauguaucuggacagaaaugacgccggagaagcgauuaguuuuccaaccacgcuaggaaugaacaaauguuacauacagaucauggauuuaggacauacaugugacgcaacaaugucauacgaaugcccaaugcuagaugaaggaguagaaccugacgauguagacuguugguguaauacuacuucaaccuggguaguauauggaacaugucaccacaagaaaggagaagcaagaagaucaaggagagcagucaccuuaccaucacauagcacaagaaaauuacaaacaagaucucaaacuuggcuugagagcagagaauacacaaaacauuuaauaagaguagaaaauuggauauuuagaaauccaggauuugcuuuagcagccgcagcgauagcaugguuacuaggaagcucaacaucccaaaaaguuauauauuuaguaaugauauuauuaauugcuccugcauauucgauaagauguauuggaguaucaaauagagauuuugucgaaggaaugagcggagggacauggguagauguuguacuagaacacgguggaugcguuacaguaauggcacaagauaaaccaacagucgauauagaauuaguuacaaccacaguaaguaacauggcagaaguaagaucguauuguuaugaggccuccauuucagauauggcaucugauucacgaugcccaacacaaggagaagcauaucuugauaaacaaucagauacccaauauguuuguaaaagaacuuuaguugacagagguuggggaaauggcuguggucuauucggcaaaggaagccuaguaacaugugccaaauucgcauguucgaagaaaaugacuggaaaaucuauucaaccugaaaacuuagaauauagaauuauguuaucagugcaugguucacaacacaguggaaugauaguaaaugacacaggacaugaaacagaugaaaacagggcaaaaguagaaauaacaccaaauucacccagagcugaagcuacauuagguggauuuggaagucucggacuagauugcgaaccaagaacaggauuagauuuuagugaucuauauuaccuaacaaugaacaacaaacauuggcuuguucacaaagaaugguuccacgauauuccccuacccuggcaugcaggagcagacacagguacaccucauuggaauaauaaagaagcauuaguagaauuuaaagaugcacaugcaaaaagacaaacaguaguaguacuaggaucucaagaaggugcaguacauacugcccuagcaggagcccucgaagcggaaauggauggagcaaaaggaagauuaucaucuggccaucuaaaaugcagauuaaaaauggacaaacuaagacuuaaaggaguaaguuauagucucuguacagcagcauuuacauuuacaaaaauuccagcagaaacuuuacaugguacuguaacaguagagguucaauaugcaggaacagauggaccauguaaaguccccgcacaaauggcgguggacaugcaaacacuaacuccaguaggaagacuaauaacagcaaauccaguaauaacagaaucaaccgaaaacucgaaaaugauguuagaauuagacccaccuuuuggugauagcuauauuguaauagguguaggagagaaaaagauaacacaccauuggcauagaagugggucaacacuaggaaaagcauuuagcacaacacuaaaaggcgcacaaagauuggcagcauuaggugacacagcuugggacuucggcagcauaggaggaguauuuaauucaauuggcagagcaguacaccaaguauuugguggagcuuuuagaacuuuauucgguggaaugaguuggauuacacaagguuuaaugggagcuuuacuacuauggauggguguaaaugcaagagauaggagcauagcauuagcauuucuagcaacagguggagugcuaguauucuuagcaacgaacguacaugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11342 - RNA, 2281 nt, Artificial Sequence
  ZIKV (strain MR 766) prME-short variant mRNA Design 1 opt
gggagaaagcuuaccaugaaugaaggcucaauaauguggcuagcaucacuagcaguaguaauagcaugcgcuggagcuauaacuagaagaggaucagcuuacuacauguauuuagauagaagugacgcagguaaagcaauaucauuugcaacaacacuaggagucaacaaaugucauguacaaauaauggauuugggacacaugugugaugcaacaaugagcuacgaaugcccaauguuggacgaaggaguagaaccugaugauguugacuguugguguaauacaacaagcacuugggucguauaugguacaugccaucauaagaaaggagaagcaagacgaucuagacgagcaguaacacuuccgagucauucuacaagaaaauuacaaacgagaagccaaacuuggcuagaaucuagagaauauacaaaacaucuaauaaaaguagaaaauuggauauuuagaaauccaggauucgcauuaguagcaguggcaauugcauggcuauugggaagcaguacgagccaaaaaguaauauaucuaguaaugauauuacuaauagccccugcuuacagcauaagaugcauaggaguaucuaauagagauuuuguugaaggaaugucuggagguacuugggucgacguaguguuagaacauggaggauguguaacaguaauggcacaagacaaaccaacaguagacauagaauuagucacuacaacuguaucgaauauggcugagguaagaagcuauuguuaugaagcaagcauaagugauauggcauccgacaguagauguccaacucaaggagaagccuaucuagauaaacaaagugauacgcaauauguauguaaaagaacccuaguagacagaggguggggaaauggauguggauuauuuggaaaaggaagucuuguaacaugcgcaaaauucacauguucaaagaaaaugaccggaaaaagcauucaaccugaaaaucuagaguaucgaauaauguuaucuguacauggaucacaacauucaggaaugauaggauacgaaacggacgaggauagagcaaaaguagaaguaacaccaaauaguccaagggcagaagcuacauugggaggauuuggcagcuuaggauuagauugcgaaccacgcacaggauuagauuuuagcgauuuauauuauuuaacaaugaauaauaaacauuggcuaguacauaaagaaugguuucaugauauaccucuaccauggcacgcuggagcagauacaggaacaccacauuggaacaacaaagaggcgcuuguagaguucaaagacgcacacgcgaaaagacaaacaguaguuguuuuaggaagucaagaaggagcuguacacacagcauuagcaggagcuuuagaagcagaaauggacggagcaaaaggaagauuguuuaguggucaucuaaaauguagacuaaaaauggacaaauuaagauuaaaaggugucaguuauucauuauguacagcugcauucacauuuacaaaaguuccugcggaaacuuuacauggaacugucacugucgaaguacaauacgcgggaaccgauggacccugcaaaauaccuguacaaauggcuguagacaugcaaacauuaaccccaguaggaagauuaauaacagcaaauccaguaauaacagaaaguaccgaaaauucaaaaaugauguuagaacucgacccacccuuuggagauucauacauagucauaggaguaggagauaagaaaauaacacaucauuggcaucgaaguggcucaacacuagggaaagcauuuucaacuacgcuuaaaggugcacaaagauuagcagcuuuaggugacacagcaugggauuuuggaagcauaggaggaguauuuaacucaauagguagggcuguacaucaaguauuuggaggugcguuucgaacauuauucggaggaaugaguuggauaacucaaggauugaugggggcuuuacuguuauggauggguguaaaugcuagagauagaaguauugcauuggcauuuuuagcaacuggaggaguguuaguguuuuuagcaacaaauguacaugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11343 - RNA, 2293 nt, Artificial Sequence
  ZIKV (strain NatalRGN) prME-short variant mRNA Design 1 opt
gggagaaagcuuaccaugaaugaaggaaguaucaugugguuagcaaguuuagcaguaguaauugcaugcgcaggggcaguuaccagaagaggcagcgcuuacuauauguacuuagacagaaacgacgcaggagaagcgaucucauucccaacaacauuaggaaugaauaaauguuauauucaaauuauggacuuaggacacaugugugaugcuaccaugucauaugagugcccaaugcuugaugaaggaguggagccagacgacguugauuguuggugcaauacaaccucaacuuggguuguauauggaacaugucaucauaaaaagggagaagcaagaagaucaagaagagcaguaacacuaccuucacauucaacaagaaaauuacaaacacguucgcaaacaugguuagaaucaagagaauauacaaaacaucugauaagaguggaaaauuggauauuccgaaauccaggcuucgcauuagcagcugcggcaauugcaugguuacugggaucaucuacaagucaaaaaguaauuuacuuaguuaugauacuauuaauagcaccagcauacucaauaagguguauaggaguaagcaauagagauuucguagaaggaaugucuggcgguacguggguggacguaguacuggaacacggaggauguguuacaguaauggcacaagacaaaccgacuguugauauugaauuaguuacaacuacaguuucaaauauggcagaaguaagaucauauugcuaugaagcaucaauaucugauauggcuucagauucaagaugucccacucaaggagaagcauaucuugauaaacaaucagacacccaauacguaugcaaacgaacauuaguagauagaggauggggaaacggaugcggacuuuuuggaaaaggaagucuagucacaugugcaaaauucgcaugcaguaaaaaaaugacugguaaaucaauucaaccagaaaauuuagaauacagaauaaugcucaguguacauggaagccaacauucaggaaugauaguaaaugauacaggacacgaaacagacgaaaauagagcuaaaguugaaauaacgccaaacucacccagggcggaagcaacucuaggugguuuuggaucucuaggauuagauugcgaaccuagaacaggauuagauuucucagacuuauauuacuuaacaaugaauaauaaacauugguuaguucauaaagaaugguuucacgacauuccuuuaccauggcaugcuggagcugauacaggaacaccacauuggaauaauaaagaggcauuaguggaauucaaagacgcacaugcgaaaagacaaacaguuguaguauugggaagucaagaaggagccguccauacagcacuagcgggggccuuagaagcggaaauggauggagcaaaagguagauuaucaaguggacaucuaaaaugucgauuaaaaauggauaaauuaagguuaaaaggagucaguuacagucuauguacagcugcauucacauucacaaaaauaccagcagaaacauuacauggaacaguuacugucgaaguucaauaugcaggaacugacggaccauguaaaguaccagcucaaauggccguagauaugcaaacacuaacaccaguaggaagacuaauaacagcaaacccaguaauaacagaaucuacggaaaauucaaaaaugauguuagaguuagauccaccauucggagacagcuacauaguaauaggaguaggagaaaaaaaaauaacucaucauuggcaucgaaguggaucaacauuaggaaaagcguuuucaacaacauuaaaaggagcucaaagacuagcagcacucggagacacugcaugggauuuuggaaguauaggagggguauuuaauagcaucggaagagcaguacaucaaguauucgguggagcuuucagaacuuuauuugguggaaugaguuggauuacacaaggacugaugggcgcacuacuauuauggaugggagugaaugcaagagauagaucaauagcauuggcauuccuagcaacugguggaguacucguauuuuuggcaacaaauguacacgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11344 - RNA, 2320 nt, Artificial Sequence
  ZIKV (strain ZikaSPH2015) ME variant mRNA Design 1 opt
gggagaaagcuuaccaugggaagaaaacaaaauaaaagaggugggaaugaaggaucaauaauguggcuagcuucacuagccguaguuauagcuugugcaggagcagugacaagaagaggaagugcauauuacauguacuuggacagaaacgaugcuggugaagccauaaguuuuccaaccacguuagguaugaauaaauguuacauucaaauaauggauuugggacauaugugugaugcuacaaugaguuaugaauguccaauguuagacgaagguguugaaccagacgauguagauugcuggugcaauacaacaaguacauggguuguauacgggacaugccaccacaagaaaggcgaagcaaggagaaguaggagagcggucacauuaccgagucauucuaccagaaaauuacaaacgagaagucaaacaugguuagaaagcagagaauauacaaaacauuuaauuagaguugaaaauuggauauuuagaaauccaggauucgcguuggcggcagcagcaauagcaugguuacucggaucaagcacaagucaaaaaguaauauaccuaguaaugauacuguuaauagcgccagcauauucaauacgauguauuggcgugagcaacagagacuuuguagaaggaaugucuggugguacauggguagauauagugcuagagcauggaggaugcgugacaguuauggcacaagauaaaccaacuguagacauagaauuaguaacaacuacaguuucaaauauggcagaaguuagaaguuauuguuaugaagcaucaauaagugacauggcaucagauuccaggugcccuacacaaggcgaagcauauuuagauaaacagucagauacacaauaugucuguaaaagaacgcuaguagauagaggauggggaaauggaugcggacuuuuugguaaaggaucauuaguaacaugcgcaaaauuugcauguucaaagaaaaugacaggaaaaucaauacaaccagaaaauuuagaauaccguauaauguuauccguacaugguagucaacauagugguaugauaguaaaugauacaggacacgaaacagaugaaaauagggcuaaaguugaaauaacaccgaacuccccacgagccgaagcuacauuaggaggauucgguagccuaggauuagauugugaaccgagaacagguuuagauuuuucagaucuauauuaucuuacaaugaacaacaaacauuggcuaguucacaaagaaugguuucaugacauaccacuuccauggcaugcaggagcagacacaggcacaccacauuggaauaauaaagaagcucuaguagaauuuaaagacgcucaugcaaagagacaaacaguuguaguccuaggaagucaagaaggugcaguucacacagcacuagcaggagcucuagaagcugaaauggauggagcgaaagguagacuaucaagcggacaccuuaaauguagguuaaaaauggauaaauuaagauugaagggaguaaguuauagcuuaugcaccgcugcauuuacauucaccaaaauaccggcagaaacuuuacauggcacgguuacaguagaaguccaauaugcaggaacggauggaccaugcaaaguacccgcacaaauggcaguagauaugcaaacauuaacuccuguaggccgacuuauaacggcaaauccuguuauaacagaaaguacugaaaauucaaaaaugauguuagaacuagacccuccauucggagauaguuauauaguaauuggaguaggagaaaagaaaauaacgcaucauuggcauagaagcggaucaacuauagguaaagcauuugaagcaacaguacgaggagcaaaaagaauggcaguacuaggagauacggcaugggauuuugguucaguaggaggagcauuaaauucauuaggaaaaggaauacaccaaauauuuggagcagcauuuaaaaguuuauucggaggaaugucaugguucagucaaauacuaauaggaacucuacuaauguggcuagguuuaaauaccaaaaaugguucaauaucauuaauguguuuagcuuuaggggguguauuaauauuucuaucuacagcuguauccgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11345 - RNA, 2320 nt, Artificial Sequence
  ZIKV (isolate Z1106033) ME variant mRNA Design 1 opt
gggagaaagcuuaccauggggagaaaacaaaauaaaagaggaggaaacgaaggaaguauuaugugguuagcuucauuagcagucguaauagcuugugcuggagcaguaacuagaagaggcucagccuacuauauguauuuggaccgaaaugaugcuggugaagcaaucucuuucccaacuacuuuagggaugaacaaauguuauauacaaauaauggaucuuggacauacaugugaugcgacaaugucauaugaauguccaaugcuagaugaaggaguggaaccugaugacguagauuguugguguaauacuacaucaacauggguagucuaugguacaugucaccauaagaaaggagaagcacgaaggucacgcagagcaguaacauuaccaucacacucaacaagaaaauuacagacaagaagccaaacauggcuagaaaguagagaauauacaaaacauuuaauaagaguagaaaacuggauuuuuagaaacccaggauuugcauuagcagcagcagcaauagcauggcuauuagguucaucaaccagucaaaaagugauauaucugguaaugauauuauuaauagcaccagcauauucaauaagaugcauuggaguaucaaauagagauuuuguugaaggcauguccggaggaacauggguagacguaguccuagaacauggagguugcguaacagucauggcucaagauaaaccuaccgucgacauagaauuaguaacuacaacaguaucaaauauggcugaaguacgaagcuauugcuacgaagcaaguauuucagauauggcaucagacaguagaugcccaacucaaggugaagcauauuuagacaaacaaagugauacacaauauguauguaaaagaacucucguagaucggggauggggaaauggaugcggacuuuuuggcaaaggcucacuugugacuugugcaaaauuugcguguaguaagaaaaugacaggaaaaucaauacaaccggaaaauuuagaauaucgaaucauguugucaguacacggaucacaacauagcggcaugauagucaaugauacgggacaugaaacugaugaaaauagagcuaaaguagaaauaacaccaaauucaccaagagcagaggcgacauuaggaggauuuggaucacuaggacuagauugugaaccaaggacaggauuagacuuuagugaccuauauuauuuaacuaugaacaauaaacauuggcuaguacauaaagaaugguuccacgauauaccuuuaccauggcaugcaggagcagauacgggaacaccccauuggaauaauaaagaagcacucguagaguucaaagaugcacacgcaaaaagacaaacaguaguaguauuaggaagucaagaaggugcaguacauacugcauuagcaggagcauuggaagcagaaauggacggagcaaaaggucguuugucaucaggacauuuaaaguguagauuaaaaauggauaaauuaagacuuaaaggagucaguuauucguuauguacagcugcauuuacauucacaaaaauaccagcugaaacacugcacggaacaguaacgguagaaguacaauacgcaggaacggacggaccguguaaaguuccugcacagauggcaguagauaugcagacacuuacuccaguagguagguuaauaacugcaaauccagucaucacagaaucuacagaaaauaguaaaaugauguuagaauuagaucccccauuuggagauucauauauaguaauagggguuggcgaaaagaaaauaacacaucauuggcauagaucaggaucaaccauaggaaaagcauuugaagcaacaguaagaggugcaaaaagaauggcagugcuaggcgacacagcaugggauuuuggaucaguaggaggagcacuaaacagccuaggaaaagguauacaucaaauauuuggagcugccuuuaaaaguuuauucggaggaaugucuugguuuagucaaaucuugauaggaacucuauuaaugugguuaggauugaaugcgaaaaauggaucaauuucacuaauguguuuagcauuaggagggguuuuaauauuuuuaaguacagcagugagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11346 - RNA, 2308 nt, Artificial Sequence
  ZIKV (strain MR 766) ME variant mRNA Design 1 opt
gggagaaagcuuaccaugggacgaaaacaaaacaaaagaggagggaaugaaggcucgauaaugugguuagcaucuuuagcaguagucauugcaugugcuggagcaauuacaagaagagguucagcuuauuacauguaccucgauagaagcgacgcagggaaagcaauuucauucgcgacaacauuaggaguaaauaaaugucauguucaaaucauggacuuaggucacaugugcgacgcaacaaugagcuacgaauguccaauguuggacgaaggcguggaaccagaugauguagauuguugguguaauacuacaucaacaugggugguauauggcacuugccaucauaagaaaggagaagcaaggagaucaaggagagcgguaacccuaccaagucauaguacuagaaaauuacaaacuagaagccaaacauggcuugaaaguagagaauacacaaaacauuuaauaaaaguugaaaauuggauauuuagaaauccaggauuugcauuaguagcaguagcaauugcuugguuauuagguagcagcacaagccaaaaaguaauauaccuaguaaugauauuauuaauagcaccagcguacaguaucagauguauaggaguaagcaauagggacuuuguagaaggaaugucaggaggaacguggguagauguaguacuagaacaugguggauguguaacaguaauggcacaagauaaaccaacaguagacauagaacuuguuacaacuacaguaaguaacauggcagaaguaagaagcuacuguuacgaagcgucuauaucagauauggcaucagauucaagauguccaacacaaggagaagcauacuuagauaaacaaucggacacucaauauguaugcaaaagaacccuaguagauagaggauggggaaauggaugcgggcuauucggaaaaggaucauuaguuacaugugcaaaauuuacauguaguaagaaaaugacaggaaaaucaauacaaccagaaaacuuagaauauagaauaauguuaaguguucauggaucacaacauuccgggaugauuggcuaugagacagaugaagacagggcaaagguagaaguuacaccaaauucaccccgagcagaagcuacuuuaggaggauuugguagccugggauuagacugugaaccuagaacgggauuggauuuuagugauuuauauuaucuaacaaugaauaauaaacauugguuaguccauaaagaaugguuucacgacauaccauuaccauggcacgcaggggcugacacaggaaccccacauuggaauaauaaagaagcauuaguugaauuuaaagacgcgcaugcaaaaagacaaacaguaguaguguuaggaagccaagaaggagcagugcauaccgcucuagcgggagcacuagaagcagaaauggauggagcaaaaggaagguuauuuucaggacaucuaaaauguagacuaaaaauggauaagcuaaggcuuaaggggguaaguuauaguuuauguacagcagcuuucacauuuaccaaaguaccagcggaaacguuacauggaacgguaacaguagaaguacaauaugcaggaacagauggcccguguaaaauaccgguucaaauggcaguagacaugcaaacauugacacccguugguagauuaauaacagcaaauccaguaauaaccgaaucuacagaaaacucaaagaugaugcuugagcuagauccaccauuuggagacagcuauauuguaauagguguaggggauaagaaaauuacacaucauuggcaucgaaguggaucgacuauagguaaagcauuugaagcuacaguaagaggugcaaaaagaauggcaguuuuaggagauacagcaugggacuuuggaaguguuggggguguuuuuaauucacuagguaaagggauacaucaaauauuuggagcugcauucaaaucauuauuugguggaaugucaugguuuucacagauacugauaggaacacuauuaguaugguuaggguuaaauaccaaaaaugguucaauaaguuugacaugucuagcauugggaggagucaugauauuucuuaguacagcuguaagcgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11347 - RNA, 2320 nt, Artificial Sequence
  ZIKV (strain NatalRGN) ME variant mRNA Design 1 opt
gggagaaagcuuaccaugggcaggaaacaaaauaaaagaggaggcaaugaaggaaguauuaugugguuagcaucauuagcggucguuauagcaugugcaggcgcaguaacaagacguggaagugcauauuacauguauuuggacagaaaugaugcaggagaagcaauaagcuuccccacaacgcuaggaaugaauaaauguuauauacaaauaauggauuuaggacacaugugugacgcaacaaugucuuaugaauguccaauguuggaugaaggaguagaaccagaugauguagauugcugguguaauacuacaaguacauggguaguuuauggaacaugccaucauaaaaaaggcgaagcaagacgaagcagaagagcggucacacuaccuucacauucaacccgaaaauuacagacaagaagccagacauggcuugaaucaagggaauauacaaaacacuuaaucagaguggaaaacuggauauuuagaaauccaggauuugccuuggccgcagcagcaaucgcauggcuacuuggaucaaguacuagucaaaaagucauauaucucguaaugauacuuuuaauagcaccagcuuauaguauaagauguauaggagucucaaauagagacuuuguagaaggaaugucaggaggaacauggguagacguaguauuagaacaugguggauguguaacaguaauggcucaagacaaaccaacaguagauaucgaauuaguaacuacaacugugagcaacauggcagaaguuagaucauauugcuaugaagcaucuauaucugacauggcuucagauucccgauguccaacacaaggagaggcuuauuuagauaaacaaucugacacacaauauguauguaaaaggacuuuaguagauagaggauggggaaaugguugcgggcuauuuggaaaaggcucguuaguaacaugugccaaauucgccugcaguaaaaaaaugacaggaaaaucaauacaaccugaaaauuuagaauauagaauaauguugucaguacauggaucucaacauucggggaugauaguaaacgauacaggacacgaaacagacgaaaauagagcaaaaguugagauaacaccaaauucaccucgagcagaagcaacacuggggggguuuggaagucucggauuggacugugaaccaagaaccggacuagauuuuucagauuuauauuauuugacaaugaacaauaaacacugguuaguacauaaagaaugguuccaugauauaccacuacccuggcaugcaggagcagauacagguaccccacacuggaauaauaaagaagcacuaguagaauuuaaagaugcacacgcaaaaagacaaacaguaguaguauuaggcucacaagaaggagcaguccacacugcacucgcaggugcgcuagaagcugaaauggauggagcaaaaggcagauuaagcaguggacacuuaaaauguagacucaaaauggauaaauuaagacuaaaaggcguaaguuauagucuauguacagcagcauucacauucacaaaaaucccagcagaaacacuacauggaacagucacaguagaaguacaauaugcuggaacagauggaccauguaaaguuccagcacaaauggcaguugacaugcagacacuaacaccaguaggacgacuaaucacagcaaauccagucauaacugagucaacagaaaauaguaaaaugauguuagaauuagauccuccauuuggugauucauauauaguaauuggaguuggagaaaaaaaaauaacgcaucauuggcacagaaguggaucgacaauaggaaaagccuuugaagcaacgguaagaggggcuaagaggauggcugugcuaggagauaccgccugggauuucgguuccguaggaggagcacuuaacagcuuagguaaaggaauucaucaaauuuuuggugcugccuucaaaucauuguuuggaggaaugucaugguucucacagauauuaauagguacguuguuaauguggcuuggauuaaacacaaaaaaugguucuauaagcuuaaugugcuuagcauuaggaggaguauuaauauuucucucaacagccguuagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11348 - RNA, 2293 nt, Artificial Sequence
  ZIKV (strain ZikaSPH2015) ME variant mRNA Design 1 opt
gggagaaagcuuaccaugaaugaagguucaauaaugugguuagcaucauuagcaguugugauagcaugcgcaggcgcagucacaaggagaggcucugcuuauuacauguauuuagaucgaaaugaugcaggggaggcaauaaguuuuccaaccacacuuggaaugaacaaauguuauauacaaauaauggauuuaggacauaugugcgaugcaacuaugucauacgaauguccaauguuagaugaaggagucgaaccagaugacguggauugcugguguaauacaacgagcacguggguaguauauggaacuugucaccauaaaaaaggagaagcuagacgaagcagaagagcaguaacauuaccaagucauagcacacguaaacuccaaacacgaucacaaaccugguuagagagcagagaauauacuaaacacuuaauaaggguagaaaauuggauuuuuagaaauccuggauucgcauuagcggccgcugcaauagcaugguuauugggaaguucgacaagccaaaaagucauauauuuaguaaugauuuuauuaauagccccagcauauucaauaagauguauaggcguaucaaauagagauuuuguagaagggaugaguggaggaacauggguagauauaguucuagaacauggaggaugcguaacagucauggcucaagauaaaccuacaguugacauagaacuaguaacaacaacaguaucaaauauggcagaaguaagaagcuacuguuaugaagcuucaaucucggacauggcaucagauucaagauguccaacgcaaggagaagcuuauuuggacaaacaaagcgacacccaauaugucuguaaaagaacauuaguggauaggggaugggguaauggauguggccuauuuggaaaaggaagccuaguaacaugugcaaaauuugcaugcaguaaaaaaaugacuggaaaaucaauucaaccagaaaaccucgaauauaggauaauguuaaguguacauggaagucaacacaguggaaugauaguuaaugauacaggccaugaaacagacgaaaacagagccaaaguagaaauaacuccaaauucaccacgagcggaagcgacacuaggaggauuugggucauuaggauuagauugcgaaccaaggacaggauuagauuucagugauuuauauuauuuaacaaugaacaauaaacauugguuaguacacaaagaaugguuucacgacauaccccucccauggcaugcaggagccgauacagggacuccucauuggaacaauaaagaagcguuaguagaauuuaaagaugcucacgcuaaaagacaaacaguuguaguacuaggaucgcaggaaggagcagugcauacagcauuagcaggugcacuagaagcagaaauggauggcgcaaaaggaagacuaaguucaggacauuuaaaauguagauuaaaaauggauaaauuaagauuaaaaggaguuucuuauagucuaugcacugcagcuuuuacauuuacaaaaauaccggcagaaacgcuacaugggacaguuaccguagaaguucaauacgcaggaaccgacggcccaugcaaaguaccagcacaaauggcuguugauaugcaaacauuaacaccgguuggaagacucauaacagcuaauccaguaauaacagaaucaacagaaaacucaaaaaugauguuagaauuagauccuccauucggagacaguuacauaguaauaggugugggagaaaaaaaaauaacccaucauuggcacagaaguggaaguacaauaggaaaagcauucgaagcuacuguacgaggcgcgaaaaggauggcgguauuaggagauacagcaugggacuuuggaucgguaggaggagcauuaaauucauuagguaaaggaauacaucaaauauuuggagcugcauuuaaaaguuuauuugguggaaugagcugguuuagucaaauauuaauaggaacauuauuaaugugguuagggcuaaauaccaaaaauggaucaauaagucuaaugugucuagcauuagguggugugcuuauauuuuuaaguacagcagucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11349 - RNA, 2293 nt, Artificial Sequence
  ZIKV (isolate Z1106033) ME variant mRNA Design 1 opt
gggagaaagcuuaccaugaacgaaggaagcauaaugugguuggcaucauuagcaguagucauagcaugugcaggagcgguaacaagaaggggaagugcuuauuauauguauuuagauagaaaugaugcaggagaagcaauaucauuuccuacaacacuaggcaugaacaaaugcuauauacaaauaauggauuuaggacauacaugugaugcaaccaugagcuacgaaugucccauguuagacgaaggaguagaaccagaugauguagauugcugguguaacacuaccucaacauggguaguauacggaacaugucaucauaagaaaggagaagcaagaaggagccguagagcaguaacauuaccaagucauagcacaagaaaacuacaaacacguagccagacauggcuggaaucuagagaauauacaaaacauuuaauaagaguugaaaauuggauauuuagaaauccuggauuugcauuggcugcggcugcaauagccugguuacuaggaucaucaacaucucaaaaaguuaucuauuuaguaaugauacuacuaauagcaccagcuuauucaauacgaugcauaggaguuucaaacagagacuucguugaaggcauguccgguggcacauggguagauguaguacuagaacacggaggaugcguaacaguaauggcacaagauaaaccaacuguagauaucgaauugguaacaaccacagugucaaauauggcugagguaagaagcuacuguuaugaagcaucaauuucagauauggcaagugacucacguuguccgacacaaggugaagcauaucuagauaaacaaucagauacacaauauguuuguaaacgaacauuaguagaccgagguuggggaaaugguugcggacuauuuggaaaagguucacuggucacaugcgcgaaauuugcaugcucaaagaaaaugacaggaaaaaguauacaaccugaaaaucuggaauauagaauuauguuaucaguucauggcucucaacacucaggaaugauaguaaacgauacuggucaugaaacugaugaaaauagagcuaaaguugaaauaacaccaaacaguccgcgagcggaagcaacauuaggcggauuuggaagucuuggacuagacugugaaccgagaacaggauuagacuuuagugauuuauacuaucuaacaaugaacaauaaacauugguuaguacacaaagaaugguuucacgauaucccuuuaccauggcacgcaggagcugacacaggaacgccucauuggaauaacaaagaagcauuaguagaauuuaaagacgcgcaugcaaaacgacaaacaguaguaguacuagggucacaagaaggagcaguacauacugcauuagcaggagcauuagaagcagaaauggacggagccaaagguagauuaagcagcggacaucuaaaaugcagacuaaagauggauaaauuaaggcuaaaaggaguaucuuacagccuguguacagcugcauucacauuuacuaaaauuccagcagaaacauuacauggaacaguuaccguagaagugcaauaugcaggaacagauggcccauguaaaguaccagcucaaauggcuguugauaugcaaaccuuaacgcccguuggacgacuaauaacugcaaaucccguaauaacagaaaguacagaaaacuccaaaaugaugcuugaauuagauccaccauuuggagauucuuauauuguaauagguguaggugaaaagaaaauuacacaucacuggcacagaaguggaucaacaauaggaaaagcauuugaagcaacaguccgaggugcaaaaagaauggcaguacuaggagauaccgcuugggauuuugguucaguagguggagccuuaaacaguuuaggaaaaggaauacaccaaauauuuggagcagcauuuaaaucauuauucggaggaaugaguugguuuagccaaauauugauugguacgcuguuaauguggcuaggacuaaaugcaaagaauggaaguauaucauuaaugugcuuagcccuuggaggaguauuaauuuuucucaguacagcagucucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11350 - RNA, 2281 nt, Artificial Sequence
  ZIKV (strain MR 766) ME variant mRNA Design 1 opt
gggagaaagcuuaccaugaaugaagguagcauaaugugguuagcaaguuuagcaguaguaauugcuugcgccggagcaaucacgagacgaggaucagcauacuauauguacuuagauagaagcgaugcaggaaaagcuauaagcuuugcuacaacauuaggaguaaauaagugucaugugcaaauaauggacuugggacauaugugugaugcaaccaugucuuaugaauguccaauguuagaugaaggaguagaaccugacgauguagauugcugguguaauacaacaucaacauggguuguauacggaacgugccaccauaaaaaaggagaagcaaggagaucaagaagagccguaacacuaccaagucacucaacacgaaaacuacaaacaagaagucaaacaugguuagaaagcagagaauauacaaaacauuuaauaaaaguagaaaauuggauauucaggaauccagguuuugcuuuaguugcaguagcuauagcuuggcuauuaggaagcagcacgucacaaaaaguuauuuaucuaguaaugauacuacugauagcaccagcguacucaauaagaugcauuggaguuucaaauagagauuuuguagaaggaaugagcggaggaacuuggguagacguaguucuagaacaugggggaugcguaacaguuauggcacaagacaaaccaacaguagauaucgaacuaguaacaacuacaguaucaaauauggcagaaguacgaaguuauugcuacgaagcaucaaucucggauauggcaagugauagucguuguccgacacaaggcgaagcauacuuagauaaacaaagugauacgcaauaugucuguaaaagaacauuaguagacagaggguggggaaauggaugcggacuauuugguaaaggauccuuaguaacaugcgcuaaauucacuugcucuaaaaaaaugacagggaaaaguauacaaccugaaaaccuggaauaucgaauaauguuaucaguucauggaucacaacauucaggaaugauaggauacgaaacggaugaagauagagcaaaaguagaaguaaccccaaauaguccuagagcugaagcuacacuaggagguuuuggcucacuaggauuagauugugagcccagaacaggacucgauuucagugaucuauauuauuuaacaaugaauaauaagcauuggcuaguacacaaagaaugguuucaugacauaccucugccauggcaugcaggagcagauacaggaacaccccacuggaauaauaaagaagcuuuagucgaauucaaagacgcucacgcaaaaagacagacaguugucguuuuaggaagucaagaaggagcaguacauacagcucuagcuggugcauuagaagcagaaauggauggugcaaaaggaagauuauuuagcggacaucuaaaaugucgauuaaaaauggauaaauuaagauuaaaagggguaucauauagucuauguacagcagcauucacauuuacgaaaguaccggcagagacauuacauggaacaguaacaguugagguccaauacgcaggaacagacggacccuguaaaauaccugugcaaauggccguagacaugcaaacguuaacuccaguaggaagacuaaucaccgcaaauccaguaauaacugaaucaacugaaaauaguaaaaugaugcuugaauuagauccaccauucggagauucauauauaguaauuggaguuggugauaaaaaaaucacacaucauuggcauagaucagggucaacaauaggaaaagcauucgaggcgacaguaagaggagcuaaaagaauggcuguucuaggagauacagcaugggauuucggcagcguaggcgguguauucaacagcuuaggaaaagggauacaucaaauauuuggcgcagcauuuaaaagucuauuuggugguaugucgugguuuucacaaauacuaauaggaacccuauuaguuugguuaggacuaaauacaaaaaacggaucaauaucucuaacaugcuuagcauuaggaggagugaugauuuuucuaagcacagcaguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11351 - RNA, 2293 nt, Artificial Sequence
  ZIKV (strain NatalRGN) ME variant mRNA Design 1 opt
gggagaaagcuuaccaugaacgaaggaaguauaaugugguuagcaaguuuagcagucguaauagcaugugcgggagcaguaacuagaaggggaagugcauauuauauguaccuagauaggaaugacgcuggugaagcaauaucauuuccaacuacuuuagggaugaauaaaugcuauauacaaauaauggauuuaggucauaugugugaugcaacaaugaguuaugaauguccaauguuggacgaaggaguagaaccagaugacgucgauuguugguguaauacaacaagcacauggguaguuuacggaacgugucaccacaagaaaggagaggcaagacgaaguagacgagcagucacauuaccaagccacaguacaagaaaacuucaaacuagaagucaaaccuggcuagaaucaagagaguacacaaaacaccuaauaagaguagaaaauuggauauuuagaaauccaggauuugcucuagcagcagcagcaauagcaugguuacuaggaagcaguacaagucaaaaaguuauauaucuaguaaugaucuuauuaauagcucccgcguacucgauaagauguauuggagugaguaauagagauuuuguagaaggcaugucaggcgguaccuggguagauguagugcuagaacauggaggaugcguaacaguaauggcacaagauaagccaacaguagauauagagcuaguaacgacaacaguuucuaauauggcagaaguuagaaguuauugcuaugaagcuaguauaucagacauggcaagcgacaguagaugcccaacacaaggagaagcauauuuagauaaacaaagugauacacaauaugucugcaaacgaacucuaguagacagaggguggggaaaugguuguggauuauucgggaaaggaucauuaguuacaugcgcuaaauuugcauguagcaagaaaaugacaggcaaaaguauacaaccagaaaauuuagaauauagaauaauguuaucaguacacgggucgcaacauaguggaaugauuguuaaugacacaggccaugaaacagaugaaaacagggcgaaagucgaaauaacaccaaacuccccaagggcagaagcaacauuaggaggauuuggaagucuaggucuagacugugaaccaagaacugguuuagauuuuagugaucuauauuacuuaacuaugaauaacaaacauuggcuagugcauaaagaaugguuucaugauauacccuuaccauggcaugcaggagcagauacaggcacaccucauuggaauaauaaagaagcauugguagaauuuaaagaugcacacgcaaaacgccaaacaguaguaguacuaggaucacaagaaggugccguacauacagcacuagcuggugcacuugaagcagagauggauggcgcuaaaggacgauuaucaucaggacaccuaaaaugucgacugaaaauggauaaacuaagacuaaaagggguaaguuauucacuauguacagcagcauuuaccuuuaccaaaauaccagcugaaacauuacauggaacuguaacuguagagguacaauaugccgguacugauggaccauguaaaguaccagcacaaauggcaguagauaugcaaacauuaacgccaguaggaagauugauaacagcgaauccaguaauaacagaauccacagaaaacucaaaaaugaugcuagaauuagauccaccuuuuggagauucuuauauaguaaucggaguuggagaaaagaaaauaacucaucauuggcacagaucaggaaguacaauagguaaagcauuugaagccaccguaagaggagcuaaaagaauggcaguauuaggagauacagcaugggauuuugguaguguaggaggugcacuaaauucacuagguaaagggauacaucaaauauuuggggcagccuuuaaaucauuauuuggaggaaugaguugguuuucucaaauauuaauaggaacuuuauuaaugugguuaggacucaacacuaaaaacggaagcauaaguuuaauguguuuagcacuuggaggaguacuaauuuuucuaagcacagcaguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11352 - RNA, 2320 nt, Artificial Sequence
  ZIKV (strain ZikaSPH2015) prME-short variant mRNA Design 1 opt
gggagaaagcuuaccaugggacggaaacaaaacaaaagaggaggcaacgaaggcucaauaauguggcucgcaagccuagcaguaguaaucgcaugcgccggggcgguaacacgacgcggcucagcauacuacauguaccuggaccgcaacgacgccggcgaagcuauauccuuccccaccacgcucggaaugaacaaaugcuacauacaaauaauggaccuuggccacaugugcgacgcaacaauguccuacgaaugccccaugcuggacgaaggaguagaaccggacgacguagauugcuggugcaacaccacgaguaccugggucguauacggcacaugccaccacaaaaagggcgaagcacgccgaagccgacgagccgucacccugcccagccacagcacccgcaaacuccagacccgcagccaaaccuggcuggaaagccgagaauacaccaaacacuuaaucagagucgaaaacuggaucuucagaaaccccggauucgcucucgcagccgccgcaauagcauggcugcucggcucguccacaucacaaaaagucaucuaccuaguaaugauccuccugaucgccccagccuacagcauccgcugcauaggaguaagcaaccgugacuucguggaaggaaugucaggaggcaccuggguagacauaguccucgaacacggaggcugcgucacaguaauggcacaagacaaaccaaccgucgacaucgaacucguaaccacaaccguauccaacauggcggaggucagauccuacugcuacgaagccagcaucagcgacauggccuccgacuccagguguccaacccagggagaagcauaccucgacaaacaaucugacacccaauacgucugcaaacgaacccuagucgaccgaggguggggcaacggcugcggacuguucgggaaaggaagucuaguuacaugcgcaaaauucgccugcagcaaaaagaugacaggaaaaucaauacagccagagaaucucgaguacagaauaaugcucuccguccacggcucacaacacucaggcaugauaguaaacgacacgggacacgaaacagacgaaaacagagcaaaggucgagaucacacccaacagcccacgugcggaagcaacacugggaggcuuuggcagccuaggacuggacugcgaaccccgcaccggccucgacuucagcgaucucuacuaccucacgaugaacaacaagcacuggcugguccacaaggaaugguuucaugacauaccacuaccauggcacgcaggcgccgacacagggacaccccacuggaacaacaaagaagcacuggucgaguucaaagacgcgcacgccaaaagacaaaccguaguaguccuaggcucccaagaaggagcaguccacacggcacuagccggcgcgcucgaagcggaaauggacggagccaaaggaagacuaaguucaggacaccuaaaaugcagacuaaaaauggacaaguuacgacugaaaggagucucguacagccucugcacggcagccuucacauucaccaagauaccagcagaaacccuacacggcaccguaacggucgagguacaauacgccggaaccgacggaccaugcaaagucccagcacaaauggcagucgacaugcaaacccuaacacccgucggccggcuuaucacagcaaacccgguaaucacagaaaguacagagaacuccaaaaugaugcucgaacucgacccgcccuucggagacagcuacaucgucaucggcgucggcgagaagaaaaucacacaccacuggcaccggagcggaucaacgaucggcaaagcauucgaagccacaguaagaggugcaaaacgaauggccguccuaggggauacagcaugggacuucggcagcguaggcggcgcacugaacagccuugggaaaggcauacaccaaaucuucggagcagcauucaaaagccuguucggaggcaugagcugguucucucaaauccuaauaggaacccuccucauguggcucggccuaaacaccaaaaauggaagcaucagccucaugugccuagcacuaggaggcguccuaaucuuccugaguacagccguaagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11353 - RNA, 2320 nt, Artificial Sequence
  ZIKV (isolate Z1106033) prME-short variant mRNA Design 1 opt
gggagaaagcuuaccaugggccgaaaacaaaacaaacgcggaggcaacgaaggauccauaauguggcuagcuucccuggccguuguaauagcgugcgcuggcgccgucacacgacgaggauccgccuauuacauguaccucgaccgcaacgacgccggagaagcaauaucauucccgacaacccuugggaugaacaaaugcuacauacagaucauggaccucggacauaccugcgacgcaaccauguccuacgaaugcccaaugcuagacgagggagucgagccagacgacguggacugcuggugcaacaccacaagcacaugggugguauacggaaccugccaccacaagaaaggcgaagcccgucgaagcaggcgagcagugaccuuaccaagccacagcaccagaaaacuccagacacgcucacaaacauggcucgaaagcagggaauacacgaaacaccuaaucaggguagaaaacuggaucuuccgaaacccaggcuucgcccucgccgccgcagcaaucgcauggcuacuaggcucgagcacaagccaaaaagucaucuaucucgucaugauacuccuaauagcacccgcauacucaauacgaugcauaggugucagcaaccgcgacuucgucgaaggaaugagcggaggaaccuggguagacguaguccucgaacacggcggauguguaacagucauggcccaagacaaaccuacagucgacauagagcuaguaaccacgaccguaagcaacauggcagaaguacgaagcuacugcuacgaagccucgaucagcgacauggcaagcgacucccgcugcccaacccagggagaagcauaccuggacaaacaaagcgacacacaauacgucugcaaacggacacucgucgaccgcggauggggaaacggcugcggacuauucggcaaaggcagccuaguaacaugugcaaaauucgccuguuccaagaaaaugaccgggaaaucaauacaaccggaaaaccuagaauaccgaauaaugcucagcgugcacggaucacaacacucugggaugauaguaaaugacaccggccacgaaacugacgaaaaccgcgccaaaguagagaucacccccaacucgccccgcgcagaagccacacuaggcggcuucggaucccugggccucgacugcgaaccacgaacgggacuagacuucucagaucucuacuaccucaccaugaacaacaaacacuggcuaguccacaaagaaugguuccacgacaucccacuccccuggcacgccggagcagauaccggaaccccgcacuggaacaacaaagaagcgcuagucgaguucaaagacgcacacgcaaaaagacaaacggucgugguacuaggcucccaagaaggcgcaguccacaccgcucuggccggugcacuggaagcggaaauggauggcgcuaaaggccgccucucaagcggccaccucaaaugccgacuaaaaauggacaaacuacgccucaaaggggucagcuacagccuaugcacagcagccuucaccuuuaccaaaauaccagcagaaacccuacacgguacaguaaccguugaagugcaauaugcaggaacagacggacccugcaaagucccggcacaaauggcagucgacaugcagacccugacaccaguaggccgacuuaucacagccaacccagucaucaccgagucaacagaaaacuccaaaaugaugcucgagcuagacccaccauucggagauagcuacaucguaaucgggguaggggaaaagaagauaacacaccauuggcacagaagcggcagcacuauaggaaaagcauucgaagccacagugaggggagcaaaacgcauggccgugcucggcgacacagcaugggacuucggcuccguaggcggcgcccugaacagccugggaaaaggaauacaccaaauauucggagcggcauucaagucccuauucggcggcaugucaugguucucacaaauacugaucggcacacugcuaauguggcuaggccucaaugcuaagaacggcagcauaagccucaugugccuagcgcucgggggaguacuaaucuuucuaaguaccgccgugagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11354 - RNA, 2308 nt, Artificial Sequence
  ZIKV (strain MR 766) prME-short variant mRNA Design 1 opt
gggagaaagcuuaccaugggccguaaacaaaacaaacgaggaggcaacgaaggaagcauaauguggcuagccucccucgcaguaguaauagccugcgccggcgcaaucacccgccgaggcucggccuacuacauguaccuagacaggagugacgcaggcaaagccaucagcuucgcaacaacccucgggguaaacaaaugccacguacaaaucauggaccucggacacaugugcgacgccacgaugucauacgaaugccccaugcuagacgaaggagucgaacccgacgacguagacugcuggugcaacacaaccagcacgugggugguauacggaacaugccaccacaagaaaggagaagcacgaaggagcagaagggcagugacccuaccgagccacuccacccgcaaacuccaaacacggagccaaacauggcucgaaagccgagaauacacaaaacaccucauaaagguagaaaacuggaucuuccgcaacccaggcuucgcccuagucgccguagcaauagccuggcuacuagguuccagcacaucccagaaggucauauaccuggucaugauauuacuaauagcgccggcauacagcauucgaugcauaggcguaagcaaccgagacuucguagaaggcauguccggcggaaccugggucgacgucguacucgagcacggagggugcguaaccgugauggcccaagauaagcccacagucgacauagaacucguaaccaccacggucaguaacauggcagaagugagauccuacugcuacgaagcguccauaagcgacauggccucagacagccgauguccaacccaaggggaagccuaccuggacaaacaaucagacacucaauacgucuguaagagaacccuagucgacagaggauggggcaacggaugcggacuauucggcaaaggcucacucgucacaugcgcaaaauucacaugcuccaagaagaugacaggaaaaagcauacaaccagaaaaccucgaguacagaauaaugcucuccgugcacggcucacaacacagcggaaugaucggcuacgaaacugacgaagaccgcgcaaaaguggaggugacacccaacucaccccgcgcagaagccacccucggcggauucggcagccucggccuagauugcgagccacgaacaggccuagacuucagugaccuauacuaccuaacaaugaacaacaaacacugguuagugcacaaagaaugguuccacgauaucccacuacccuggcacgcaggcgccgacacagggaccccacacuggaacaacaaagaggcccucguagaguucaaagacgcacacgccaaacgacagacaguaguaguacugggaucucaggaaggcgcggugcacaccgcacuagcgggcgcccuggaagccgaaauggacggagcaaaaggacgccucuucuccggacaccugaaaugcagacucaaaauggacaaacugcgccucaaaggcgucagcuacagccugugcaccgcagcauuuaccuucacaaaagucccugcagaaacacuccacggaacagugacaguagaaguacaauacgccggcacagauggcccaugcaaaauacccguccagauggccgucgacaugcaaacccuuaccccagucggacgccucaucacagcaaacccggucauaaccgaauccacagaaaacucgaaaaugaugcuggaacucgacccacccuucggcgacaguuacauaguaaucgguguaggagacaagaaaaucacacaccacuggcaccgcagcggcucaacuaucggcaaagcauucgaggccacagucagaggcgcaaaacgaauggcuguccuaggcgacacagccugggauuucggcagcguaggcggcgucuucaacucccucggcaaaggaauacaccaaauuuucggggccgcauucaaaucacucuucggaggaaugucaugguucucgcaaauccucauaggcacccuccuaguauggcucggacucaauaccaaaaacggaucaaucagccuaaccugucuugccuuaggaggaguaaugaucuuccucagcaccgcagucagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11355 - RNA, 2320 nt, Artificial Sequence
  ZIKV (strain NatalRGN) prME-short variant mRNA Design 1 opt
gggagaaagcuuaccaugggccgaaagcaaaacaaacgcggcggcaacgaaggaucaaucauguggcucgccucccucgcaguaguuaucgccugcgccggcgccgucacgcgacgcggcucagcauacuacauguaccuggaccgaaacgacgcaggcgaagccauauccuuccccaccacccucggaaugaacaagugcuacauucaaaucauggaccugggucacaugugugacgccacaauguccuacgaaugcccaaugcuggacgaaggcgucgaaccagacgacgucgacugcuggugcaacacuacaucaacauggguaguauacgggaccugccaccacaagaaaggcgaagcacgacgcuccagacgagcagucacacugcccucccacuccacccgaaaacuacagacacggucccaaacauggcucgaaagcagggaauauaccaaacaccuaauccgcgucgagaacuggauauuucgaaaccccggcuucgcacucgccgccgccgccaucgccuggcuccuaggauccagcacaucacaaaaagucauauaccucguaaugauacuacucauagcgcccgcauacagcauaagauguaucggcguaagcaaccgagacuucguagaaggcaugucaggaggcacaugggucgauguaguccuagaacacggaggcugcguaacagucauggcccaagacaaaccaaccgucgacauagagcuagugacaaccaccguaucaaacauggccgaaguaagaucauacugcuacgaagccuccaucuccgauauggcaagcgacucacguugccccacccaaggugaagccuacuuagacaaacaaagcgacacacaauacgucugcaaaaggacccucguagaucgcggauggggaaacggcugcggacuauucgguaaaggaucgcucgugacaugugccaaauucgccugcuccaagaaaaugacaggcaaauccauccaaccagaaaaccuagaauaccgcauaaugcucucaguacacggaucccaacacagcggcaugaucgucaacgacacaggccacgaaaccgacgagaacagagccaaaguagaaauaacacccaauagcccacgcgcagaagccacacucggcggauucggaucucucggccucgacugcgagccacggacaggacuugacuuuuccgaccucuacuaccugaccaugaacaacaaacacuggcuagugcacaaggaaugguuccaugacaucccucuccccuggcacgcaggagccgacacgggcacaccgcacuggaauaacaaagaagcccucguagaguucaaggacgcacacgccaaacgacaaacggucgucguccuaggaucacaagaaggcgcaguacacacagcgcucgccggagcccuagaggcggagauggacggggcaaaaggccgccucuccaguggacaccucaagugccgacucaaaauggauaagcuccgacucaaaggcguaucuuacucccuaugcaccgccgcauucacauucacgaaaauccccgccgaaacccuccacggcacggucaccgucgaaguacaauacgcaggcaccgauggcccaugcaaaguaccagcacaaauggcaguggacaugcaaacacucaccccagucggacgacucaucaccgcaaacccagucaucaccgaauccaccgaaaacucaaaaaugaugcuagaacucgacccacccuucggcgauaguuacaucgucauaggcgugggggaaaagaagauaacacaucacuggcaccgaucaggguccacgaucggcaaagccuucgaggccacaguacgcggagcaaagcgcauggcaguccuaggagauacagccugggauuucgggaguguaggcggcgcccuaaacagccuaggcaaaggcauacaccaaauauucggcgccgccuucaaaagccuauucggaggcaugagcugguucagccaaauacucauaggaacgcuccucauguggcuuggacuaaacacaaagaacggaagcauaagccucaugugccuagcacuaggaggcguacuaaucuuccugagcaccgcggucagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11356 - RNA, 2293 nt, Artificial Sequence
  ZIKV (strain ZikaSPH2015) prME-short variant mRNA Design 1 opt
gggagaaagcuuaccaugaacgaagggucaaucauguggcuugcaucccuagcaguagugaucgccugcgcgggcgcggucacacgacggggcuccgccuacuacauguaccucgaccgcaacgacgcaggcgaagcaaucagcuuccccacaacgcuaggaaugaacaaaugcuauauacaaauaauggaccucggccacaugugcgacgcaaccaugagcuacgaaugcccaaugcuagacgaaggcguggaaccggacgacguggacugcuggugcaacaccacauccacaugggugguauacgguaccugccaccacaagaaaggcgaagcacgaaggucacggagagcagucacccuaccaucccacagcaccagaaaacuacaaacacgaucccagaccuggcuagaaagccgcgaauacacgaagcaucuaauaagggucgaaaacuggauauuccgaaaccccggauucgcacuagccgcagcggcaauagcauggcuacuagggucaagcacgucccaaaaaguaauuuacuuaguaaugauccuccuaauagcaccagccuacucaaucagaugcauaggcguaagcaaccgagacuucguagaaggcaugagcggcgggaccuggguagacauaguacucgaacacggaggcugcguaaccguaauggcacaagacaaaccaacaguagacaucgagcuaguaaccacaacaguaucgaacauggcggaaguacgcuccuacugcuacgaagccucgaucuccgacauggccagcgacucacgcugcccgacccaaggggaagcauaccuagacaaacaauccgacacgcaguauguaugcaaacgaacacugguugaccguggaugggggaauggaugcggacucuucggaaaaggcucgcucgucacaugcgccaaauucgccugcagcaagaaaaugaccggcaaaagcauucaaccagaaaaccucgaauaccgaaucaugcucagcguacacggcucacaacauagcgggaugauagucaacgacacaggacacgaaacggacgaaaaucgggcaaaagucgaaaucaccccaaacucaccacgcgcagaagccacacucggaggcuucggcagccuaggacuagacugcgaacccagaacgggacuagacuucagcgaccucuacuacuuaaccaugaacaacaaacacuggcugguccacaaagaaugguuccacgacauaccacucccauggcacgcaggcgccgacaccgggaccccacauuggaacaacaaagaagccuuaguagaguucaaagacgcgcacgcaaaaagacagacagugguaguacugggaagccaagaaggcgcaguccacacagcacuagccggagcgcuggaagccgaaauggacggcgccaaaggcagacuauccuccggacaccucaaaugccgccucaaaauggacaaacuacgccuaaaaggagucagcuacucacucugcacagccgcguucaccuucacuaaaauacccgcagaaacccuacacgggaccgucaccguagaaguacaauacgccggcacugacggaccaugcaagguaccagcccaaauggccgucgacaugcaaacccuaacucccguaggacgacucaucacggccaaccccguaauaaccgaaagcacagagaacucaaaaaugaugcucgaacuagacccacccuucggagacagcuacaucgucaucggcguaggcgagaaaaagauuacccaccacuggcacaggagcggcagcacgaucggaaaagccuucgaagccacagucagaggggccaaacgcauggccguacugggcgacacagccugggacuucggcaguguaggaggggcccucaacagccucggaaaaggcauccaccaaauuuucggagccgcuuuuaaaagucuauucggaggaauguccugguucucacaaauacucauuggcacacuccuaauguggcucggccuaaacaccaagaacggcagcaucagccuaaugugccuagcccucggcgggguacuaauauuccugagcacagccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11357 - RNA, 2293 nt, Artificial Sequence
  ZIKV (isolate Z1106033) prME-short variant mRNA Design 1 opt
gggagaaagcuuaccaugaacgaaggcucgaucauguggcucgccucccuagcagucgucaucgcaugcgcaggagcagucacccgccggggauccgcguauuacauguaccucgaccggaacgaugcaggagaagcaaucagcuucccgaccacacucgggaugaacaaaugcuacauacaaauaauggaccucggacauaccugcgacgcaaccauguccuaugaaugcccgaugcuugacgaaggagucgaaccagacgacguagacugcuggugcaacaccacaagcacaugggugguauacggcacaugccaccacaagaaaggagaagcgcgcaggaguagacgcgccgucacccucccaagccacucaacacgcaaacuccaaacacgaucacaaaccuggcucgaaagccgagaauacaccaagcaccuaauccgcgucgagaacuggaucuuccgcaacccaggauucgcgcucgccgcagcagccaucgccuggcuccuaggguccagcaccagccaaaaggugaucuaccuagucaugauacuccucaucgcaccagcauacucgauccgcugcauaggcguaucaaauagagacuucguagagggaauguccggcggaaccugggucgacguaguccuagaacacggcggcugugucaccgugauggcacaagacaaaccaacaguagacauagaacuuguaacaacgacaguaaguaacauggcggaaguccgcagcuacugcuacgaagcauccauaucagacauggccagcgacagccgcugccccacgcaaggcgaggcauaccuagauaagcaaucagacacccaauaugucugcaaaagaacccuaguggaccgcggcuggggcaacggaugcggccucuucgggaaaggcucccucgucacgugcgccaaauucgccugcucaaagaaaaugaccggaaaaagcauacaacccgaaaaccuagaauaccgaaucaugcucucgguacacggaucacaacacagcggaaugaucguaaaugacaccggacaugagacagacgaaaacagggccaaagucgaaaucaccccaaauaguccccgcgcagaagccacccucgguggguucggcagucucggacuagacugugaaccacgaaccggccucgacuucagcgaccuauacuaccuaacaaugaacaacaaacacuggcucguccacaaagaaugguuccacgauaucccgcuacccuggcacgccggagccgacaccgggacaccacacuggaacaacaaagaagcccucgucgaguucaaagacgcgcacgcuaaacgccaaaccguagugguccucggaucccaggaaggagccguacacaccgcacuagcaggagcccucgaggccgaaauggacggcgcaaaaggaagacucucaagcggccaccucaagugcagacucaaaauggacaaacuaagacugaaaggaguauccuacucccucugcacggccgccuucacauucacuaaaaucccagccgaaacgcuccacggaacaguaacaguggaagugcaauacgcgggaacugacggaccaugcaaaguacccgcccaaauggccgucgacaugcaaacacuaacaccagucgggcgacuaaucacagccaauccaguaauaacggaaucaaccgaaaacaguaaaaugaugcuagaacuagacccacccuucggagacagcuauauaguaaucggagucggagaaaagaaaauaacccaccacuggcacagaagcgggagcaccaucgggaaagccuucgaggcaacggugagaggcgcaaaacgaauggccguccucggagacaccgcaugggacuucggauccgugggcggagcccugaacucacuaggaaaaggcauccaucaaauauucggggccgccuucaaaucccucuucggcgggaugucgugguucucacagauacucaucgggacacuacucauguggcucgggcucaacgccaaaaacggaagcaucucacucaugugccuagcacuagggggaguccuaaucuuccuguccacagcaguaagcgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11358 - RNA, 2281 nt, Artificial Sequence
  ZIKV (strain MR 766) prME-short variant mRNA Design 1 opt
gggagaaagcuuaccaugaacgagggcucaaucauguggcuggccucacuagccguagugauagcaugcgcaggcgcaaucacacgccgggguucagcauacuacauguacuuagacagaagugacgcaggaaaagcaaucucauucgccacaacccuaggagucaacaaaugccacguacaaauaauggaccuaggccacaugugcgacgcaacgauguccuacgaaugccccauguuggacgaaggcguagagcccgacgaugucgacugcuggugcaacaccacgaguaccuggguagucuacggcacgugccaucacaagaaaggagaagccagaaggucgaggagagcagucacacugccgagccacagcacacgaaaacuccagacacgaucccagaccuggcucgaaagcagggaguacacaaaacaccucauaaaagucgaaaacuggaucuucaggaacccaggauucgcgcuaguagcaguagccaucgccuggcugcuagguagcagcacgucccaaaaagucauauaccucguaaugauccuauuaauagcaccagcauacucgauaagaugcauaggaguaaguaaccgagacuucguagaaggaaugucaggcggcacauggguagacguaguacuagaacacgguggaugcguaaccgugauggcacaagacaaacccacaguagacauagagcuaguaaccacgacuguaagcaacauggcugaaguccgaagcuacugcuacgaggcaucgaucuccgacauggccuccgacagccgcugcccaacacaaggagaagccuaccuagauaaacaaucggacacgcaauacgucugcaaacgcacucuagucgaccgcggauggggaaacggcugcggacuguucggaaaaggcagccuaguaacaugcgccaaauuuaccugcucaaagaaaaugaccggcaaaucaauacagccagaaaaucucgaauacagaaucaugcuaucaguacacggcucgcaacacagcgggaugaucggguacgaaacagaugaagaccgagcaaaaguagaagucacaccgaacagcccaagagcagaagccacacuuggaggguucggaucacuaggcuuggacugcgagccacgcacaggucuagacuucagcgaccuguacuacuugaccaugaacaacaaacauuggcuaguacacaaagagugguuucacgacauaccccuccccuggcacgccggcgccgacaccggcaccccacauuggaacaacaaagaagcgcuggucgaauuuaaagacgcgcacgcaaaacgacagacggucguaguacucgggagucaagaaggcgccguccacacagcccucgcaggggcgcuagaagcagaaauggacggggcgaaagggaggcuauucaguggccaccuaaaaugccggcucaaaauggacaaacuacgauugaaaggagucucauacucacuaugcaccgcggcguucacauucacaaaagucccggccgagacacugcacggaaccguaaccgucgaaguacaguacgcaggaaccgauggccccugcaagaucccgguacaaauggcggucgacaugcaaacccucacccccguaggacgacuaauaaccgcaaaccccgucauaacagaauccacagaaaacagcaaaaugaugcuagaacucgacccgcccuucggugacuccuacaucguaaucggugucggcgacaagaaaaucacacaucacuggcaccgaagcggcagcacaaucggaaaagcauucgaagccacagugcgcggcgcaaaacgaauggcaguacugggcgacaccgcuugggacuucggcagcgucgggggcguauucaacagucuaggcaaaggcauucaccagaucuucggagcagcguucaagagccuauuuggaggcauguccugguucagccagauucuaauaggcacacuucuagucuggcuaggacuaaacaccaaaaacggaagcaucagccuaaccugccucgcgcucggaggcguaaugauauuccuaagcacugccguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11359 - RNA, 2293 nt, Artificial Sequence
  ZIKV (strain NatalRGN) prME-short variant mRNA Design 1 opt
gggagaaagcuuaccaugaacgagggaagcauaauguggcucgcaucauuagcagucguaaucgccugcgccggagccgugacgagacgcggcuccgccuauuacauguaccuagaucgaaacgacgcaggcgaagccauaucauucccaacgacacuaggaaugaacaagugcuacauacaaauaauggaccuaggccacaugugcgacgcaaccaugagcuacgaaugcccaaugcucgacgaaggcgucgaacccgacgacguagacugcuggugcaacacuacauccacauggguagucuacggaacgugccaccacaaaaagggcgaagcaagacgaagcagacgcgccgucacacucccaagucacagcacccgaaaacuccaaaccagaagccagacauggcuagaauccagggaguacaccaaacaccuaauaagagucgaaaacuggaucuuccggaacccaggauuugcccuagcugcggcggcgauagcauggcuacucggcucaucaacaagccagaaagucaucuaccucguaaugauccugcucauagcaccagcguacucaauaagaugcauaggcgucagcaacagggacuucguugaaggcaugucaggcggcaccuggguggacguaguccucgagcacggaggcugcgucacaguuauggcacaggacaaacccaccgucgacaucgaacucgucacaaccacagucagcaacauggccgaaguccgcagcuacuguuacgaggcaagcaucagcgacauggccucggacuccaggugcccaacacaaggagaggcauaucuggacaagcagagcgacacacaguacgucugcaaacgaacgcuaguggaccgcggauggggaaacggcugcggacuuuucggcaagggaagccuaguaacuugcgcaaaguuugccugcucaaagaaaaugaccggaaaaagcauccaaccggaaaaccuagaauacagaaucaugcugagcguccacggaucccaacacagugggaugauaguaaacgacacaggacacgaaacagacgaaaaccgagccaaagucgaaaucacacccaacagcccgcgagcagaagcaacacucgggggcuucggaucacuaggacuagacugcgaaccacgcacagggcuagacuucagugaccuguacuaccuaacgaugaacaacaagcacuggcucguucauaaagaaugguuccacgacaucccccuaccguggcacgcaggggcagacacaggaacaccccacuggaacaacaaagaagcccucguggaguucaaagacgcacacgccaaacggcaaaccguaguaguccuuggaagccaggaaggagccguccacaccgcgcucgccggcgcccuagaagccgaaauggacggcgcaaagggacgacucagcagcggacaccuaaagugccgccuaaaaauggauaaacuccgccucaaaggcguaagcuacagccuaugcaccgccgccuucacauuuaccaaaauaccagccgaaacacuccacggcaccguaacagucgaaguacaauacgccgggacggacggaccaugcaagguccccgcccagauggcagucgacaugcagacccucaccccaguagggagacuaaucacagccaacccugucauaacggaauccaccgaaaacagcaaaaugaugcuagagcuagacccgcccuucggagacuccuacaucguaauaggcgucggcgaaaagaaaauaacacaucacuggcaccgaagcggcuccaccaucgggaaagccuucgaggccacaguaagaggagcaaaacgcauggcagugcuaggcgauacagcaugggacuucggcagcguaggcggggcgcugaacucccuaggaaaaggaauacaccaaauauucggagcagccuucaagucacucuucggcggaaugagcugguucucacaaauccuaaucggcacacuccuuauguggcucggccucaacaccaaaaacgggagcauaagccucaugugccuagcacuagggggcguccuaauauuucugagcaccgcggucagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11360 - RNA, 2320 nt, Artificial Sequence
  ZIKV (strain ZikaSPH2015) prME-short variant mRNA Design 1 opt
gggagaaagcuuaccaugggacggaagcaaaacaagagaggcggcaacgaaggcaguauaauguggcucgcaagccuagcgguaguaaucgcaugugcuggagccgucaccagacgaggguccgcauacuacauguaccuagacagaaacgacgcaggagaggcaaucuccuuccccacaacacuaggcaugaauaaaugcuacauacaaauaauggaucugggacacaugugugacgccacgauguccuacgaaugcccaaugcuagacgaaggagucgaaccagacgacguagacugcuggugcaacacaacgagcacaugggucguauacgggaccugccaccacaagaagggagaagcccgccggagcaggcgcgccgugacacuaccaagucauagcacacgcaaacuccaaacccgaucacaaaccuggcuagaaagccgugaauacaccaaacaccucauccgaguggagaauuggaucuuucgaaacccaggauucgcccuagccgcagccgcgauagcauggcuauugggcagcuccaccucccaaaaagugauauaccuagucaugauacuacuaaucgccccagcauacucgauucgguguaucggggugagcaaccgcgacuucguagaaggcaugagcggcgggacaugggucgacaucguacuagaacacggcgggugcguaaccguaauggcccaagacaaacccacagucgacauagaauuaguaacgaccaccgucagcaacauggcagaaguaaggucauacugcuacgaagccucuaucuccgacauggccagcgacagcagaugccccacccaaggagaggcauaccuagacaaacagagcgacacgcaauacgucugcaaaagaacacucguagaccgcggauggggcaacggaugcggacuguucggcaaaggcucccugguaaccugcgccaaauucgcaugcagcaagaaaaugacaggaaaaagcauacaacccgaaaaccuugaguacagaauaaugcucagcguccacggaagccaacacagcggcaugauagucaacgacacaggacacgaaaccgacgaaaaccgagcaaaagucgaaaucaccccgaacucaccacgugccgaagcaacacugggaggcuucggaucacuaggcuuagacugcgaaccacgcacaggacuugacuucuccgaucuguacuaccucaccaugaacaacaaacacuggcuagugcacaaagagugguuccacgacaucccccuccccuggcacgcgggagcagacaccggcacaccccacuggaacaacaaagaagcacugguugaguucaaggacgcacacgccaaacgccaaaccguaguggugcucggcucccaggaaggagccguacacacggcacucgccggugcacuagaagcagaaauggacggagccaaaggccgcuuaagcucuggccaccuaaaguguagacugaagauggacaaacuccgccucaaaggagucagcuacucacucugcacagcagccuucaccuucaccaaaauccccgcagaaacacuacacgggacagucaccguugaaguacaauacgcaggcaccgacggacccugcaaaguccccgcacaaauggcaguagacaugcaaacccucacaccagucggccggcuaauaaccgccaaccccgugauaacagaaagcaccgaaaacagcaaaaugaugcuagaacucgacccgccauucggggacucauacaucguaaucggcguaggagaaaagaaaauuacacaccacuggcaccguucaggcaguacccuaggcaaagcauucucaacaacccuaaaaggcgcacaacgacuagccgcccugggugacacagcaugggacuucggaagcauagguggaguauucaacagcaucggacgggccguccaucaaguguucggcggcgcauucagaacccuguucggcggcaugucuuggaucacacaaggacuaaugggggcccuccuauuauggaugggcguaaacgcaagagacagaaguauagcccuggcauuccuugccacaggcggaguacugguauuccuggccaccaacguccacgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11361 - RNA, 2320 nt, Artificial Sequence
  ZIKV (isolate Z1106033) prME-short variant mRNA Design 1 opt
gggagaaagcuuaccaugggcagaaaacaaaacaaaaggggagggaacgagggcagcauuauguggcuggccagccucgccgucguaaucgcgugcgccggugcaguaacacgcaggggaagcgcauacuacauguaccuagaccgaaacgacgcaggagaagcaauuagcuucccuacaacgcuaggaaugaacaaaugcuacauccaaauaauggaccuaggucacaccugugacgcaaccaugagcuacgagugucccaugcucgacgaaggcguagagcccgacgacgucgacugcuggugcaacacaaccuccacauggguaguauauggcacaugucaccacaagaaaggagaggcacgcagguccagacgcgcgguaacccuaccaagccacagcacuagaaaacugcaaacaagaucccaaaccuggcuagagagcagagaauacacaaaacaccucauccgaguagaaaacuggauauuccgaaaccccggcuucgcgcuagcugccgcagccauagccuggcuacucggaucgagcacaagccagaaaguaaucuaccugguaaugauacuucuaaucgcaccggcguacuccaucaggugcauaggaguaagcaaccgagacuucgucgaaggaaugagcggaggaacauggguagacgucgugcucgaacacggcggcugcguaacaguaauggcacaagacaaacccacaguagacaucgagcuagucacaacaacuguaagcaacauggcagaaguacgcagcuacugcuaugaagccucaauaucagacauggcaagugauucccgaugcccaacacaaggcgaagcguaccuggacaaacaaucggacacacaguacguaugcaaacgcacccuggucgaccgaggcugggggaacggauguggacuauuuggcaagggcagccucgucaccugugccaaguucgcgugcagcaaaaagaugacaggcaaguccauacaaccagaaaaccucgaguaccgaauaaugcuauccguacacggcucccaacacuccggcaugaucguaaacgacaccggacacgaaacugacgaaaaccgcgcaaaaguugaaauuacaccaaacucgccacgugccgaagcaacucuaggcggguucggaucccuaggccuggacugcgagccaagaacaggacucgacuucagugacuuauacuaccuaacaaugaacaacaaacacuggcuaguccacaaagagugguuccaugacauaccccucccauggcacgcaggggccgacacuggaaccccacacuggaacaacaaggaagcccuagucgaguuuaaagacgcacacgcgaagcggcaaaccguaguaguccucggaucccaagaaggagcgguucauacagcacucgcgggagcccuggaagccgagauggacggagccaaaggccgccugagcucaggacaccuaaaaugccgccucaaaauggacaagcuccgacugaaaggaguaucauacucccugugcaccgccgccuucaccuucacaaagaucccagcagagacccuccacggcacagugaccguagaaguacaauacgcaggaaccgacggaccaugcaaaguacccgcccagauggcagucgacaugcaaacgcuuacaccggucggacgccugauaacagccaacccaguaaucacagaaucaaccgaaaacucuaaaaugaugcuagaacucgauccacccuucggcgacagcuacaucgucaucggagucggagaaaagaaaauaacccaccacuggcaccgauccggauccacauuagggaaagcauucagcacuacacucaaaggcgcccaacgacucgcagcauuaggagacaccgcgugggacuucggcagcauaggaggagucuucaacucaaucgggcgggcaguccaccaaguguucgggggcgcauucaggacacuauucggcggcaugaguuggaucacacaaggacucaugggagcgcuccuccucuggaugggagucaacgcuagagaccgcagcauagcccucgcauuccucgcuaccggcggcgugcucguguuccuagccacgaacguacacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11362 - RNA, 2308 nt, Artificial Sequence
  ZIKV (strain MR 766) prME-short variant mRNA Design 1 opt
gggagaaagcuuaccaugggcagaaaacaaaacaaacgcgggggcaacgagggcucgauuauguggcucgcaucacucgcagucgugauagcgugcgcaggagcgauaacgaggagaggaagcgccuacuacauguaccuggacagaagcgacgcagguaaagcaaucucguucgcaacaacacuagggguaaacaaaugccacguccaaauuauggaccuaggccacaugugcgaugcgacgauguccuacgagugcccgaugcuagacgaaggcguggaaccagacgacguagacugcuggugcaacacaacgagcacauggguggucuacggaacaugccaucacaagaaaggcgaagcccgcaggagcaggcgagcggucacucucccaagccacagcacgcggaaacuacaaacaagaagccagacauggcuugaaagccgcgaauacacaaaacaccugaucaaagucgagaacuggauauuccgaaaccccggguucgcacucguagcaguagcaauagcauggcuacuaggcucgaguaccagccagaaaguaauauaccucgugaugauacuacugaucgcgcccgccuacagcauccgcugcauaggcgucagcaacagagauuucguagaaggaaugucaggaggaacaugggucgacgucguacuagagcacggaggcugcguaacgguuauggcccaggacaaaccaacggucgacaucgaacucgugacaacaacagucagcaacauggcggaagugcgaucauacuguuacgaagcaagcauaucagacauggcaucagacucaagaugcccuacucaaggagaggcuuaccuagacaaacaaagcgacacccaguacgucuguaaaagaacauuagucgaccgaggauggggaaacgggugcggacucuucggaaaaggcucacucguaacgugcgccaaauucacaugcuccaaaaagaugacgggaaagagcauacagccagaaaaucuagaguacagaaucaugcugucaguacauggcucgcagcacagcggaaugauaggcuacgaaacggaugaagacagagccaaagucgaagucacgcccaacagcccgagagcagaagcgacccuaggcggguucggaagccugggccuagacugcgaaccgcguacgggacuggacuuuagcgaccuauacuaccucacaaugaacaauaaacacuggcuaguccauaaagaaugguuccacgacaucccgcuaccauggcaugccggggcagacacaggaacaccccacuggaacaauaaagaggcccuaguagaguucaaagacgcgcacgcaaaacgccagaccgucgugguccugggaucacaagaaggagcgguccacacagcucucgcaggagcacucgaagcagaaauggacggcgcgaaaggccgacucuucagcggccaccuuaagugcaggcucaaaauggacaaacuacgacugaaaggggucucauacagccucugcacagcagccuuuacguucacaaaaguaccagccgaaacacugcacgggaccgugacaguggaagugcaauacgccgguacagacggacccugcaaaaucccaguccaaauggcgguggauaugcaaacccuaacuccggucggccgacuaauaacggcaaauccagugaucacagaaucaaccgaaaacucaaaaaugaugcuagaacuagacccgccauucggcgacagcuacauaguaaucggggucggggacaagaaaauaacgcaucacuggcacagaagcgggagcacacucggcaaggcuuucagcacaacacuaaaaggcgcgcaaagacuugcagcacucggcgauaccgcgugggacuucgggaguauaggaggagucuucaacucaauaggacgcgcaguccaccaaguauucggaggagcauucagaacccucuucggcggcauguccuggauaacccaagggcucaugggugcgcugcuucucuggaugggggucaacgcccgggacagaagcaucgcacuagccuuucuagcaacaggaggaguacuuguauuccucgccacaaacgugcacgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11363 - RNA, 2320 nt, Artificial Sequence
  ZIKV (strain NatalRGN) prME-short variant mRNA Design 1 opt
gggagaaagcuuaccaugggacgcaaacagaacaagagaggaggaaacgaaggcagcaucauguggcuagcaucgcuagcaguaguaaucgccugcgccggcgccgucacaagacgaggcucggcauacuacauguaccuagaccgcaacgacgccggugaagcuaucucguuccccaccacgcuaggcaugaacaaaugcuacauacaaauaauggaucucgggcacaugugcgacgccacaaugucguacgaaugccccaugcuagacgaaggagucgagccugacgauguugacugcuggugcaauaccacaagcaccugggucguauacgguaccugccaccacaagaaaggcgaagcacgcagaagccgccgggcggucacccugccgagccacagcacgcgaaaacuacaaacaagaagucagaccuggcuagaauccagggaauauaccaaacaccucaucagagucgaaaacuggaucuuccgcaaccccggauucgcgcuugcagcagcagcaauagcauggcuacucgggucaagcacgagccaaaaagucaucuaccucguaaugauacuacucaucgcaccagccuacagcauaagaugcauaggagucagcaacagagacuucguagaaggcaugaguggcggcacaugggucgacgucguacuggaacacgggggcugcgucaccguaauggcacaagacaaaccaaccgucgacaucgaacucguaacaacgacagugagcaacauggcagaaguaagaucauacugcuacgaagccucaauauccgacauggccagcgacucaagaugccccacacaaggagaagcauaccuagacaaacaaucggacacccaauaugucugcaaaaggacccuagucgacagaggauggggcaacggcugcggccucuucggcaaaggaucacucguaaccugcgcaaaauucgcaugcucaaagaaaaugacgggcaaaagcauccagcccgaaaaccucgaauacagaaucaugcucagcguacacggcagccaacacagcggaaugauagugaacgacacaggacacgagaccgacgaaaaccgcgcaaaagucgagaucacaccaaacagcccacgagccgaagccacacuaggaggcuucggaagccuaggauuagacugugaaccccguaccggccuggacuucagcgaccucuauuaccucacgaugaauaacaaacacuggcugguacacaaagagugguuccaugacauaccacugccuuggcacgccggagccgacaccggcacaccccacuggaacaacaaagaggcccugguggaguucaaagacgcgcacgccaaacgacaaacagucguggucuugggaucacaagaaggcgccguacauacagcacuagcgggagcccuagaagccgaaauggacggcgcaaaaggacgccuaagcaguggacaccuuaaaugccggcuaaaaauggacaaacuaagacugaaaggaguaagcuacucacuauguacagcagcauucacauuuacaaagaucccagccgaaacacugcacggaacuguaacagucgaaguccaauacgcaggcacagacggaccauguaaaguacccgcccaaauggcaguggauaugcagacccuaacccccguagggcgauuaaucaccgcuaaccccguaauaaccgaguccacagaaaacagcaaaaugauguuagaacucgacccacccuucggagacagcuacaucgucauaggagucggagaaaagaaaauaacacaccacuggcaccggagcggaagcacacucggaaaagcauucucaaccacgcuaaaaggcgcgcaacgacuagcggcgcucggcgacaccgccugggacuucgggagcauaggcggagucuucaacagcaucgggcgagccgugcaccaggucuucggaggagcauuccggacccuuuucggaggcaugucauggaucacacaaggccuaaugggagcacuccuccucuggaugggaguuaacgcaagagaccggagcauugcccucgcguuucuagccacagggggcguccuaguauuccuagccacaaacguacaugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11364 - RNA, 2293 nt, Artificial Sequence
  ZIKV (strain ZikaSPH2015) prME-short variant mRNA Design 1 opt
gggagaaagcuuaccaugaacgaaggcucuauaauguggcuugcaucgcucgccguuguaauagcaugcgcaggcgccguaaccagacgcggaagcgcguacuacauguaccuggaccgaaacgacgccggagaagccaucuccuuccccacaacacucggcaugaacaaaugcuacauacaaauaauggaccucggacacaugugcgacgccacgaugucauacgagugccccaugcucgacgaaggagucgaaccagacgacgucgacugcuggugcaacaccaccucgaccugggucgucuacggaaccugccaccacaagaaaggagaagcccgacgaagucgcagagccguaacacuccccucccacagcacacgaaaacuccaaacaaggucacaaaccuggcucgaaucccgugaauacaccaaacaccuaauccgagucgaaaacuggaucuucagaaaccccggauucgcacuagcagcagccgcaaucgcguggcuccucggcucauccaccucccagaaagucauauaccucgucaugauacuacuaauugcaccggcguacuccauacgcugcauaggcguaagcaaccgggacuucgucgaaggaauguccggaggcacguggguggauauaguccucgagcacggaggcugcgucacagugauggcacaagacaaaccaaccgucgacauagaacucgucacaaccacaguuagcaacauggcggaaguccgaagcuacugcuacgaagcaagcauaucggacauggcgucagacucacggugcccgacacaaggggaagccuauuuagacaaacaauccgacacgcaguacgucugcaaaagaacgcuagucgacagaggauggggcaacggauguggccucuucggaaaaggcagccuaguuacaugcgcaaaauucgcaugcucaaagaaaaugacaggaaaauccauacaacccgaaaaccucgaauaccggauaaugcucucaguacacggcucacaacacagcgggaugauaguaaacgacacaggacacgaaacagacgagaacagagcuaaagucgaaaucacaccaaacucgccacgcgcagaagcgacccuuggaggauucggcagccuaggccucgacugugaacccagaacaggccuagacuuuuccgaccucuacuaccucacuaugaacaauaaacacuggcuaguccacaaagaaugguuccacgacauaccccuacccuggcacgccggggccgacacaggaacaccccacuggaacaacaaagaagcacucguggaguucaaagaugcacacgccaaaagacaaacggucgucguacugggaucacaagaaggagcagugcacacagcgcuagcaggagcacuggaagccgaaauggacggcgcaaaaggccgccuaagcuccggacaccucaaaugccgacuaaagauggacaaacuacgacucaaaggaguauccuacucacuaugcacagcggcguucacauucaccaagauucccgccgaaacccuacacggaaccgugaccguagagguccaauacgcuggcaccgacggaccgugcaaaguaccagcacaaauggccguagacaugcaaacgcucacacccgucggccgccuaaucaccgcaaaccccguaauuaccgaaucaacagaaaacuccaaaaugaugcucgaacuagauccacccuucggagacuccuacaucguaaucggugucggugaaaagaaaaucacccaccacuggcacaggucaggauccacccucgggaaagcauucagcaccacacuaaaaggcgcucaacgccuagccgcccuuggugacacugcuugggacuucggcaguauaggcggcgucuucaacagcaucggacgcgccguccaucaaguauucgggggcgcauucaggacccuauucggaggaauguccuggaucacgcaaggccucaugggggcccuccuccuauggaugggagucaacgcccgcgaccgaagcaucgcccucgccuuccucgcaaccggaggcgugcucguguuccuggccacaaacguacacgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11365 - RNA, 2293 nt, Artificial Sequence
  ZIKV (isolate Z1106033) prME-short variant mRNA Design 1 opt
gggagaaagcuuaccaugaacgaaggcagcauaaugugguuagcaucccuagccguagugauagccugcgccggcgccgucacacgaagaggaucagccuacuacauguaccuugacagaaacgacgcaggagaagcaaucucauuccccaccacccucgggaugaacaaaugcuacauacaaaucauggaccuaggccauaccugcgacgcuaccaugagcuacgaaugccccaugcucgacgaaggcgucgaacccgacgacgucgacugcuggugcaacaccaccuccacuugggucguauacggaaccugccaccacaagaaaggcgaagcacgccgaucccgccgagcugucacacuacccagccacagcacgcgcaaacuccaaacacgaagccaaaccuggcuggaaucccgggaauacacaaaacaccugauccgagucgagaacuggauauuccguaaccccggcuucgcccuugccgcagccgccaucgccuggcuccuagggagcuccacgagccaaaaagucauauaccucgucaugauccuccuaaucgcacccgccuacagcauaagaugcauaggcgucucaaaccgagacuucguagaaggcaugucaggcggcaccugggucgacgucguccuagaacacggagguugcguaacggucauggcacaagacaaaccaaccgucgacauagaacucgucaccaccacaguaagcaacauggccgaaguacgauccuacugcuacgaagcauccauauccgacauggcaagcgacucacgcugccccacacaaggggaagcauaccuugacaaacaguccgacacccaguauguaugcaaacggacccuaguagaccguggcuggggaaacggcugcggccucuucggcaaaggaucacucgucacaugcgcaaaauuugcgugcuccaagaaaaugacaggcaaaaguauacagccugaaaaccuagaauaccgcauaaugcuaagcguccacggcagccaacacuccggcaugauuguaaacgacaccggccacgagacagacgaaaaccgcgccaaagucgaaauuacccccaauucaccaagagcagaagcaacccuaggcggcuucgggagccucggacuagacugcgaaccacggaccggucucgacuuuagcgaccuauacuaccugacuaugaacaacaaacacuggcucguacacaaagaaugguuccacgacauaccccucccauggcacgccggcgccgauaccggcacaccccacuggaacaacaaagaagcgcuaguugaguucaaagacgcacacgcaaaacgacaaaccguaguaguccucggcucgcaagaaggggccguccauaccgcccucgcuggagcccucgaagccgaaauggacggagcaaaaggccgccucagcuccggccaccucaaaugcaggcucaaaauggacaaauuaagacucaaaggcgugucauacagccuaugcaccgccgccuucaccuucacaaaaauaccggcagaaacccuacacggcacagucacaguagaaguccaguacgcaggaacagacggccccuguaaagucccagcgcaaauggcaguugacaugcaaacccucacccccgucggcagacucaucacagcgaacccagucaucacagaaucaacagaaaacaguaaaaugaugcuagaacuugacccacccuucggggacagcuacauagucaucggcguaggggaaaagaaaauaacacaccacuggcaccgcucagguagcacacuaggcaaagccuucucaacaacccuaaaaggcgcacaacgcuuagccgcccuuggcgacaccgccugggacuucgguagcaucgguggaguauucaacuccaucgggcgagcgguacaccaggucuucggaggugcguuccggacccuauucgggggcaugucauggaucacccaagggcuaaugggagcucuccuccuauggaugggcguaaacgcacgagaccgguccauagcacucgccuuccuagcaaccgguggcguucuaguguuccuagccaccaacguacacgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11366 - RNA, 2281 nt, Artificial Sequence
  ZIKV (strain MR 766) prME-short variant mRNA Design 1 opt
gggagaaagcuuaccaugaacgaaggaucaaucauguggcuagccucccuagccgucguaaucgcaugcgcaggagcaauaacuagacggggaucagcauacuacauguaccucgaccgcagcgacgccgggaaagcaauauccuucgcaaccacacucggagucaacaaaugccacguccagauaauggaccucggacacaugugcgacgccacaaugucguacgaaugccccaugcuagacgaaggaguagaacccgacgacgucgacugcuggugcaacaccacaagcacauggguggucuacggcacuugucaccacaagaaaggcgaagcacgacggagccgcagagccgucacccucccaagccacagcaccagaaaacuacaaacccgcagucaaacauggcuagaaaguagggaauacacaaagcaccugaucaaaguagaaaacuggauuuuccgcaaccccggcuucgcgcucguagccgucgcgauugcauggcuccuaggcuccucaaccucccaaaaaguaauauaccuaguaaugauucuccucaucgcccccgccuacuccauccgcugcauaggcguaagcaaccgcgacuucguagagggaaugaguggcggaaccugggucgaugucguacuagaacacggaggaugcguaacaguaauggcccaagacaaacccacgguagauauagaacucguaacuaccaccguauccaacauggcagagguccgcucuuacugcuacgaagccuccaucucagacauggcaagcgacagccgcugccccacccaaggcgaagcguaccucgauaagcaauccgacacccaauacgucugcaagagaacccucguagacaggggaugggguaacggaugcggacuauucggaaagggcagccuaguaaccugcgcaaaauucacaugcuccaaaaagaugaccggcaaaucaauccaacccgaaaaucucgaauacagaauaaugcuaucaguccacggaucgcaacacuccgggaugauuggcuacgaaacagacgaagaccgggccaaggucgaaguuacgccuaacagcccccgcgcggaagcaacccuaggcggguucggaagucuaggccuggacugcgaaccgcgaaccggccucgacuucagcgaccuguauuaccucacaaugaauaacaaacacuggcucguccauaaagagugguuccacgacaucccccucccauggcacgcaggggccgacaccggcaccccacacuggaacaacaaagaagcccucguagaguucaaagacgcccacgccaaaaggcagacugucgucguacuaggcagccaagaaggcgcaguccacaccgcccuagcaggcgcacuggaagcagaaauggauggagcaaaaggacgccucuucaguggacaccucaagugccgacuaaagauggacaaacuucgacuaaaaggcgucucguacucacucugcaccgcagccuucaccuucacaaaaguaccggcagaaacacugcacgggacaguaaccgucgaaguccaauacgccggaacagacggcccaugcaagauucccguacaaauggcagucgacaugcagacccugacccccgucgggcgccuaaucacagcaaacccagugaucacagaaucaaccgaaaacuccaaaaugaugcuagaacuugaucccccauucggcgacuccuacaucgucauaggcguaggcgacaagaaaaucacccaccacuggcacagaagcggaagcacacucggcaaggcauuuucaaccacucuaaagggagcccaacgccuagcagcccuaggagacaccgcaugggacuucggaagcaucgguggcguuuuuaauucaauuggacgcgcaguucaccaggucuucggaggcgcauuccgaacacuauuuggaggaaugagcuggaucacccaagggcucaugggcgcgcuccuacuauggaugggagucaacgcacgcgacagauccauagcccucgccuuccucgcaacagggggagugcucguauuccucgcaaccaacgugcacgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11367 - RNA, 2293 nt, Artificial Sequence
  ZIKV (strain NatalRGN) prME-short variant mRNA Design 1 opt
gggagaaagcuuaccaugaacgaaggauccaucauguggcucgcgucacuagccguaguaaucgcgugugccggagccguaacccgaagaggcucggcauacuacauguaccucgaccgaaacgacgcgggugaagcaaucuccuuccccaccacacucgggaugaacaagugcuacauacaaauaauggaccucggacacaugugcgacgcaacaauguccuacgaaugcccaaugcuggacgaaggcguggaaccagacgacgucgacugcuggugcaacacaacaagcacaugggugguuuacgggaccugccaccacaagaaaggcgaagcacgccgaucccgcagagcagucacacucccgagccacagcacacgcaaacuacaaaccagaagccagacaugguuagaaagccgagaauacacaaaacaucuuauccgaguagaaaacuggaucuuccgcaaucccggguucgcacucgccgccgcagccaucgcauggcuccugggcucaagcacaucccaaaaaguaaucuaucuagugaugauccuccugauagcccccgccuacucaauacgcugcauaggaguuagcaaccgcgacuucguggaaggaauguccggcggcacaugggucgacgucguccuagaacacggcggauguguaaccgucauggcgcaagacaaacccacggucgacauugagcuaguuacgacaacaguaagcaauauggcagaaguccgauccuacugcuacgaagccucaauaagcgacauggccucagacucgcgcugccccacccaaggagaagccuaccucgacaaacaaucugacacccaauacgucugcaaacgaacccuagucgacagaggguggggaaacggaugcggccuuuucggaaaaggcagccucgugaccugcgccaaauucgcgugcucgaagaaaaugaccggcaaaagcauacaaccagaaaaccuagaauauagaaucaugcucuccguccauggcucacaacacagcggcaugauaguaaacgacacaggccacgaaaccgacgaaaaccgagccaaaguagaaauaacacccaauucccccagagcagaagcuacacuagguggcuucgggucccugggacucgacugcgaaccacgaaccggacuagacuucagcgaccucuauuaccuaaccaugaacaacaaacacuggcuaguccacaaagaaugguuucacgacauaccgcuaccauggcacgccggagcugacacagggacaccacacuggaacaacaaagaggcccugguagaguucaaagacgcgcacgcgaaacggcaaacagucguaguccugggcucccaggaaggcgcgguccacaccgcucucgccggcgcccuagaagccgaaauggacggcgccaaaggaagacugagcagcgggcaccugaaaugcagacucaaaauggacaaacugcgccuaaaaggagucuccuacagccucugcacagccgcauucaccuucacaaaaauccccgcagaaacccuacacgggacaguaaccguugaaguacaauacgcagggaccgacggaccaugcaagguaccggcacagauggcagucgacaugcaaacacuaaccccagucggccgccuaauaaccgcaaacccaguaauaacagaauccacagagaacucaaaaaugauguuagaacucgaucccccauucggcgacagcuacauagucauuggcgucggagagaaaaagauaacccaccacuggcacagaagcggauccacccuaggcaaggcauucucaaccacccuaaaaggcgcccaaagacuugcagcacucggcgacacagcgugggacuucggaagcauaggaggagucuucaacucaauagggagagcgguccaccaagucuucggcggagcguucagaacccuauucggcggcaugucauggauaacgcaaggacuaaugggcgcccuacuacuauggaugggcgucaacgccagggacaggagcauagcacuggcauuccuagccaccggcgggguccucguguuccuggccaccaacgugcacgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11368 - RNA, 2320 nt, Artificial Sequence
  ZIKV (strain ZikaSPH2015) ME variant mRNA Design 1 opt
gggagaaagcuuaccaugggcagaaaacaaaacaaacgcggcggcaacgagggcucgauaauguggcuggccucauuagcaguagucauagccugcgccggagccgucacccgccgagggagcgcauacuacauguaccuagaccgcaacgacgccggagaagccauauccuuccccacuacacucggaaugaacaaaugcuacauccaaauaauggaccucggccacaugugcgacgccacgauguccuacgagugccccaugcucgacgaaggggucgaaccagacgacguagacugcuggugcaauaccacaucaaccuggguagucuacggaacuugccaccacaagaaaggcgaagcucgccgcagccgccgagccguaacccuaccaucccacagcacgcggaaacuacagacccgaagccaaacauggcucgaaagccgcgaauacacgaaacaccuaauaagagucgagaacuggaucuuccgaaaccccggauucgcccucgccgcagccgcaaucgcguggcuacucggcuccucgacgucccagaaaguaaucuaccuagugaugauacuacucauagccccagccuacucaauccgaugcaucggggucagcaaccgggacuucguagaagggaugagcggcggaaccuggguagacauaguccuagaacacggcgggugcgugacagucauggcccaagacaaaccgacaguagacauagagcuagucaccaccacgguaaguaacauggccgaaguccgcagcuacuguuacgaagcaagcaucucagauauggccagcgacucaagaugcccaacacaaggggaagcauaccucgacaaacaaagcgacacacaguacgucuguaaacgcacccuaguagaucgaggauggggcaacggcugcggacuauucgggaaaggcagccucguaaccugcgccaaauucgccugcuccaagaaaaugaccgggaaaucgauacaaccagaaaaccucgaauaccgcauaaugcugaguguacacggcagccagcacagcgggaugauagugaacgacacaggccacgaaacggacgaaaaccgcgcuaaaguagaaaucaccccaaacucaccccgagcugaagcuacccuagggggcuucggcagucugggacuagacugcgaacccagaaccggccuugacuucagcgaccucuacuaccuuaccaugaacaacaaacacuggcucguccacaaagagugguuccacgacaucccccucccauggcaugccggagcagacacgggcacaccccacuggaacaauaaggaagcccucguagaguucaaagacgcccacgccaaacgccaaaccguaguaguccucggcucccaagaaggagcaguucacacagcacucgcgggcgcccucgaagcagaaauggacggcgccaaaggccgccucagcagcggacaccuaaagugccgacuaaaaauggacaagcuacgccucaaaggggucuccuacagccucugcacggccgccuucaccuucacaaaaauaccagcggaaacacuccacggcacaguaaccgucgagguacaauacgccggcaccgacggccccugcaaaguaccagcccaaauggccgucgacaugcaaacccucacacccgucggacgacuaauaaccgcuaacccagucauuacagaauccaccgaaaacaguaagaugaugcucgagcucgacccgcccuucggcgacucauacaucguaauaggcgucggcgagaagaagauaacccaccacuggcaccgcucaggaagcaccauaggcaaagccuucgaagcgacaguacgaggcgcaaaaagaauggcgguccuaggagauaccgccugggacuucggcucagucggaggagcacuaaacagccuaggcaaaggaauccaccaaaucuucggugccgccuucaagucgcuauucggaggcauguccugguucagucaaauccucaucggcaccuuauuaauguggcuaggacugaacacuaaaaacggaaguaucagccucaugugucuagcccucggcggaguacuaaucuuccucucgacagccgucuccgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11369 - RNA, 2320 nt, Artificial Sequence
  ZIKV (isolate Z1106033) ME variant mRNA Design 1 opt
gggagaaagcuuaccaugggacgaaagcaaaacaagcgcggagggaacgaaggauccaucaugugguuagccucacucgcaguagucauagccugcgccggcgccgucacaagaagaggauccgccuacuacauguaccuugaccgaaacgacgcaggcgaagccaucuccuuccccacaacccuggggaugaacaaaugcuacauacaaauaauggaccucggccauaccugcgacgcaaccaugagcuacgaaugcccaaugcuagaugaaggcguagaacccgacgacguugacugcuggugcaacacaaccuccacguggguuguauacggaaccugccaccacaagaaaggcgaggcacgccgcagccgacgagcagucacacuacccagccacaguacaagaaaacuccaaacgcgaagccaaacauggcucgagagcagagaauacaccaaacaccucaucaggguagagaacuggauauucagaaaccccgguuucgcccucgcagcugcagccauagccuggcucuugggcucauccaccagccaaaaaguaaucuaccuggugaugauauuacucaucgcccccgcguacucgaucagaugcaucgguguuuccaaccgagacuucgucgaagggaugagcggcggaaccuggguagacguaguccucgaacacggaggaugcgucacaguaauggcccaagacaaacccacagucgacauagagcuaguuaccaccaccguaaguaauauggcagaagugcgcucauacugcuacgaagcaucaaucucugacauggccucugacucccgaugccccacacagggagaggccuaccuagacaaacaauccgacacccaauacguaugcaaacgaacacucgucgaccgcggcuggggcaacgggugcggacuauucggaaaaggaucacucguaaccugcgccaaauucgccugcucaaagaaaaugacaggcaaaagcauccaacccgaaaaccucgaauaccgcaucaugcucuccguccacggaucccagcacuccggcaugauagucaacgacaccggacacgagacagacgaaaaccgcgcaaaagucgaaaucacaccaaacagcccccgagcagaagcaacacucggaggcuucgguucccucggccuugacugcgaacccagaacaggccuagauuucagcgaccucuacuaucucaccaugaacaacaaacacuggcucguccauaaagagugguuccacgacaucccccuacccuggcacgccggagccgauaccggcaccccacacuggaacaacaaagaagcccucgucgaguucaaagacgcgcacgcgaaaagacaaaccgucgucguccugggcucccaagaaggggcaguccacacugcccucgccggugcacuagaagcagaaauggacggcgcaaagggccgacugaguagcggucaccugaaaugcagacucaaaauggacaaacuccgacucaaaggagucucauacucacuaugcaccgccgcguucacauuuacaaaaauacccgcggaaacgcugcacggcacagugaccguagaaguacaauacgccggcaccgacggaccaugcaaagucccagcccaaauggcagucgacaugcaaacucucaccccaguuggccgacuaauaacagcaaacccuguaauaacagaaucaacagagaacuccaaaaugaugcucgaacucgacccgcccuucggagacagcuacauagucaucggggucggcgagaaaaagauuacccaccacuggcacaggagcgggagcaccaucggcaaagcauucgaagccacagucagaggcgcgaaacgcauggccguccuuggcgacacagcaugggauuucggaagcguaggcggggcauuaaacucacucggaaaaggcauacaccagaucuucggagccgccuucaaaagccuauucgggggcaugaguugguucucccaaauacuuaucggaacacuacucauguggcuaggccucaacgccaaaaacgguucuauaucacuaaugugccuagcccucggcggcguccuaaucuuccucagcacggccgucucagccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11370 - RNA, 2308 nt, Artificial Sequence
  ZIKV (strain MR 766) ME variant mRNA Design 1 opt
gggagaaagcuuaccaugggucgcaaacaaaacaaacgaggcgggaacgaaggcagcauaauguggcucgccucccucgcagucgucauugccugcgcgggggcaauaacacggagaggaucggccuacuacauguaccuagaccgcagcgaugcaggaaaagcgaucagcuucgcgaccacgcuaggcgucaacaaaugccacguacaaaucauggaccucggacacaugugcgacgcaacaaugucauacgaaugccccaugcuagacgaaggaguagaaccagacgacguagacugcuggugcaacaccacgagcacaugggucguauacggcacaugccaccacaagaaaggggaagcgcgccgcagccgacgcgcagucacacuuccaagccacagcacacgcaagcuccaaacccgaagccagacauggcucgaaagccgggaauacaccaaacaccugaucaaaguagagaacuggaucuuccgaaaucccggcuucgcccucguagccguggccaucgcguggcuccugggaucgagcacaagccaaaaaguaaucuaccugguaaugauacuccuaaucgcucccgcauacucaaucagaugcaucggcguaagcaaucgcgacuucgucgaaggcaugagcgggggaaccuggguagacgucguacucgagcacggcggcugugucaccgugauggcccaggacaagccaacagucgacaucgagcuaguaaccacaaccguguccaacauggcagaaguacgaucauacugcuacgaggcauccaucucagacauggcaucagacucgcgcugucccacacaaggcgaagcguaccuagacaaacaaucagacacccaguacguaugcaaacgaacccuagucgaccgcggauggggcaacggaugugggcuauuuggcaaaggcucacucgugaccugcgcaaaauucacaugcagcaagaaaaugaccggaaaaagcauccaaccggaaaaccucgaauaccggauaaugcugucgguccacgggagucagcacagcggcaugauaggauacgaaacagacgaggacagagcaaaagucgaagucacaccaaacuccccgcgggcagaggccacccuggguggcuucggcagccuaggacuggacugcgaaccacgcacaggccuagacuucuccgaccuauacuaccuaacaaugaacaacaaacacuggcuagugcacaaagaaugguuccacgacaucccccuccccuggcacgcaggcgcagauaccggaacaccacacuggaacaacaaggaggcccuaguagaguucaaagacgcacacgccaaacgacaaacuguaguaguccugggaucccaagaaggugcgguacauacagcccucgcaggcgcacuggaagcagaaauggacggagcaaaagggcgccucuucuccggccaccuaaagugccgccuuaaaauggacaaacugagacugaaaggugucagcuacagucuaugcaccgccgccuucaccuucaccaaaguccccgccgaaacccugcacggaaccguaacagucgaaguacaauacgccggcaccgacggaccgugcaaaauaccaguccaaauggcgguugacaugcaaacucuaacccccgucgggcgccuaauaacagcaaauccggucaucacggaaucaaccgaaaauucaaagaugaugcuugaacuagacccacccuucggcgacagcuacauagucauaggagucggagacaagaaaauaacccaccacuggcaccgaucgggcuccacaaucggaaaagccuucgaagccacgguaagaggagcaaaacgaauggccguacuuggggacacagcgugggacuucgggagcgucggaggagucuucaacucacuagggaagggaauccaccaaauauucggagccgcguucaaaucacuguucggaggaaugagcugguucucccaaauacuuaucggcacacuccucgucuggcucggacuaaacaccaaaaacggcagcauaagccugacaugucucgcguuaggcggaguaaugauauuccucuccacagccgucagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11371 - RNA, 2320 nt, Artificial Sequence
  ZIKV (strain NatalRGN) ME variant mRNA Design 1 opt
gggagaaagcuuaccaugggccgaaaacaaaacaaaagaggaggcaacgaaggcagcaucaugugguuagccucccuggccguagucaucgccugcgcaggcgccguaacccgccgcggcucagcauauuacauguaccuggaccgaaaugacgccggcgaagccauauccuucccaacgacacuaggaaugaacaaaugcuacauccaaaucauggaccucggccacaugugcgacgcaacaauguccuaugaaugcccaaugcuggacgaaggcguagaacccgacgacguagacugcugguguaacaccaccaguacaugggugguauacggcacaugccaccacaagaaaggcgaagcgcgcagauccaggcgcgcagucaccuuaccuagccacagcaccagaaaacuacaaacccgaagucaaaccuggcuagaauccagagaauacaccaaacaccugauccgcgucgagaauuggaucuuccgcaaccccggauucgcacucgcagccgcagcaaucgcauggcuacuggggucuuccacaucgcaaaaggugaucuaccugguaaugauccuccucauagcucccgcguacucaaucaggugcaucggaguauccaacagagacuucguagaaggaauguccggcgggaccugggucgauguaguacuugaacacggggguugcguaacggucauggcacaagacaaaccaaccguagacauagagcucgucacaaccacagucagcaacauggcggaaguucgaucauacuguuacgaagccagcauaucagacauggccucggacagccgaugcccaacacaaggagaggcauaccucgacaaacagagcgacacacaauacguaugcaaacgcaccuuggucgaccgcggcuggggaaacggaugcggacucuucggaaaaggcucccuaguaaccugcgccaaauucgcuugcucaaagaaaaugaccggaaaaagcauacaaccagaaaaccuugaauaccgaauaaugcucucgguccacggcucacaacacagcggaaugauagucaacgacacgggccacgaaaccgaugagaacagagccaaagucgagaucacaccaaacagcccccgagcagaggcaacacucggcggguucgguagccuaggacuagacugcgaaccacgaaccggcuuagacuucagcgaccuuuacuaucuaaccaugaacaacaaacacuggcucguccacaaagaaugguuccacgacaucccacuccccuggcacgcaggagccgacaccggcacuccccacuggaacaacaaagaagcccuagucgaguucaaagacgcacacgcaaaacgccaaaccgucgucguacugggcucacaggaaggagccguacacaccgcacuagccggagcgcucgaagcagaaauggacggcgcaaagggcagacuaucaagcggccaccugaaaugcaggcuaaaaauggacaaacuccgacucaaaggagucuccuacagccucugcacagcugccuucacauucaccaagaucccagccgaaacccugcacggaacagucaccgucgaaguacaguacgccggaaccgacggccccugcaagguacccgcccaaauggccgucgacaugcagacccugacaccaguaggacgacucauaacugcaaauccaguaaucaccgaaucaaccgaaaacucgaagaugaugcuggaacucgaucccccauucggcgacuccuacaucgucauaggggucggcgagaaaaagauaacccaccacuggcaccgcagcggcagcaccauaggaaaagcguucgaagcaaccguaagaggagcuaaaagaauggcagugcugggcgacacagccugggacuucggcucagugggaggcgccuuaaacucgcucggaaaaggcauccaccagauauucggagcagcauucaagagccucuucggcggaaugaguugguucucucaaauccucaucggcacccucuugauguggcucggccuaaacaccaaaaacggaagcaucucccucaugugccucgcccuaggaggcguccucauauuccuaagcacagcaguauccgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11372 - RNA, 2293 nt, Artificial Sequence
  ZIKV (strain ZikaSPH2015) ME variant mRNA Design 1 opt
gggagaaagcuuaccaugaacgaaggcuccauuauguggcuagcaucacuagcggucgucaucgccugcgccggcgccgucaccagacgcggcuccgcuuacuacauguaccuggaccgaaacgacgccggagaagcgauauccuucccaacaacacucgguaugaacaaaugcuacauccaaauaauggaccucggccacaugugcgacgcaaccaugucauacgaaugccccaugcuggacgaaggagucgaacccgacgacgucgacugcuggugcaacacaacaagcaccugggucgucuauggcacaugccaccacaagaaaggggaagcccggcgcagcaggcgcgcgguaacacuccccagccacuccacccgaaaacuccaaacccgcagucagacauggcucgaaucccgcgaauacaccaaacaccugauccgcguugaaaacuggaucuucagaaacccaggcuucgcccucgccgccgcagcaaucgccuggcuacugggcuccucgacaagucaaaaagucauuuaccuaguaaugauccuccuuauagccccagccuacucaaucagaugcaucggggucuccaaccgagacuucguagaaggaaugucgggcggaacauggguagacaucguccucgaacacggcggaugcguaaccgugauggcccaagacaaaccaacagucgacauagagcuagucacaacaacaguaucaaacauggccgaaguacgauccuacugcuacgaagccucuaucucagacauggcgucggacagccgcugcccgacacaaggcgaagccuaccuagacaagcaaucggacacccaauacgucugcaaacggacccuugucgaccguggcuggggcaacggcugcggccuauucggcaaaggaucacucguaaccugcgccaaguucgcaugcuccaagaaaaugacgggcaaaagcauccagcccgaaaaccuagaauaccgaaucaugcucucaguccacggcucacaacacagcggcaugauagucaacgacacuggacacgaaaccgacgaaaacagagccaaagucgaaaucacccccaacagccccagagcggaagcuacgcucggcggcuucgguucccucggccuagacugcgagcccagaaccggccucgacuucagcgaccucuacuaccucacaaugaacaacaaacauuggcugguccacaaagaaugguuccacgacauaccgcuaccauggcaugcaggcgccgacacuggaacgccccacuggaacaacaaagaggcacucgucgaguucaaagacgcacacgcaaaacgccaaaccgucgucguacuaggcucacaagaaggcgccguccauaccgcacucgcaggggcacuggaagccgagauggauggagccaaaggccgacucagcuccggccaccucaaaugccgacuaaaaauggacaaacuacgacuaaaaggcgucucuuacucacuauguaccgcagcauuuacauucacgaagaucccagcugaaacccuccacggaaccguaaccgucgagguccaauacgccggaaccgacggcccaugcaaggucccagcccagauggccguagacaugcaaacccuaacaccuguaggaagacuaaucaccgcaaaccccguaaucaccgaauccaccgaaaacagcaaaaugaugcucgaacuggacccacccuuuggcgacuccuacauagugauuggcgucggugagaaaaagauaacccaccacuggcacaggagcggcagcaccauaggcaaagccuucgaagcuacagucagaggagcaaaaagaauggccguccucggcgacacagccugggacuucgguuccgucggcggcgcccuaaacucgcuuggaaagggcauccaccaaauauucggcgcagcauucaaaucacuauucggcgggaugucaugguucucccaaauacucauuggcacucuccuaauguggcuaggccucaacaccaaaaacggcucuaucagccucaugugccucgcccuagguggcguacuaauauuccucucgaccgcaguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11373 - RNA, 2293 nt, Artificial Sequence
  ZIKV (isolate Z1106033) ME variant mRNA Design 1 opt
gggagaaagcuuaccaugaacgagggcucuaucauguggcuagcaucccucgccgucgucauugcaugcgcaggagcaguaacacgacggggcucggcauacuacauguaccuagacagaaacgacgccggggaggcaaucuccuuccccaccacgcucggcaugaacaaaugcuacauacaaauaauggaccuaggacauaccugcgaugcaacaauguccuacgaaugccccaugcucgacgaaggaguagaaccagacgacgucgacugcuggugcaauacgacaaguacuuggguggucuacggcacaugccaccacaagaaaggcgaagcacgcagaagccgccgcgcgguuacccucccaagccacucaacgcgaaagcuccaaacacgaagccaaacauggcuagaaucccgagaauacacaaagcaccugaucagggucgaaaacuggaucuuccgaaauccaggauucgcacucgcagccgccgcaauagcauggcuacuaggcucuagcacaagccaaaaaguaaucuaccucguaaugauucuccucaucgccccagccuacucaaucagaugcaucggcguaagcaaccgcgacuucgucgaaggaaugucaggcggaacuugggucgacguaguccuagagcacggaggcugcgugacaguaauggcccaagauaagcccacagucgauaucgaauuagucacaaccaccgucuccaauauggcagaaguacgaucguacugcuacgaagcauccauaucagacauggccuccgacucgcgcugccccacccaaggagaagcguaccuagacaaacaauccgacacgcaauacgucugcaaaagaacgcugguagaccgaggcuggggcaacggaugcggccucuucggcaaaggcucacuggucaccugugcaaaguucgccugcuccaagaaaaugacaggcaaaagcauacagccggaaaaccucgaguaccggauaaugcuauccguccacggcagccaacacucagggaugauagucaacgacaccggccacgaaacagacgaaaaccgagccaaggucgaaaucacacccaacucaccccgcgccgaagcaacccugggaggcuucggaucccucgggcucgacugcgagccccgcaccggccuagacuucagcgaccucuacuaccucacaaugaacaacaaacacuggcuaguacacaaggaaugguuccaugacauaccacuccccuggcacgcaggagcggacacaggcaccccacacuggaacaacaaggaagcccugguugaguucaaggacgcgcacgcaaaacgucaaacagucguagugcucggcucccaagaaggagccguccauaccgcccuagccggagcgcucgaggccgaaauggacggagcaaagggacgccuaagcuccggccaccuaaaaugccggcuaaaaauggacaaauuacgccuaaaaggcgucucauacucgcuaugcaccgcagccuucacauucacaaaaauccccgccgaaacacugcacggaacaguaaccgucgaaguacaauacgccggaaccgacggccccugcaaagucccggcacaaauggccgucgacaugcaaacacugacuccagucggcagacucauaaccgcaaacccaguaauaacagaauccacugaaaacucgaaaaugauguuggaauuagacccacccuucggagacagcuacauagucaucggaguaggcgaaaagaaaauaacacaccacuggcacaggagcggcucaacaaucggcaaagccuucgaggcaacugucagaggcgccaaaagaauggccguacuaggcgacaccgcaugggauuucggaaguguaggaggagcccuaaacagccuaggaaaaggcauucaccaaauauucggagccgccuucaagucccuauucggaggcaugucaugguucagccaaauacucauaggaacguuacugauguggcucggccucaacgccaaaaacggaagcaucagccucaugugccucgcgcuaggaggaguccucauauuccugagcaccgcaguaagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11374 - RNA, 2281 nt, Artificial Sequence
  ZIKV (strain MR 766) ME variant mRNA Design 1 opt
gggagaaagcuuaccaugaacgaaggcagcaucauguggcuagcaucgcuggccgucgucaucgcaugcgcaggcgcgaucacccgcaggggaucagcauacuauauguaccuagaccgcagugacgccgguaaggcaaucagcuucgccacgacacucggcguaaacaaaugucacguacaaauaauggaccucggacacaugugcgacgccaccaugaguuacgaaugccccauguuagacgaaggaguagaacccgacgacguagacugcuggugcaacaccaccuccacaugggucgucuacggaaccugccaccacaagaaaggggaagcacgccgaucacggagggcagucacccugcccagccacagcacgcgaaaacugcaaacccgaagccaaaccugguuagaaucacgagaauacaccaaacaccucaucaaaguagaaaacuggauuuuccgaaacccggguuucgcccuaguagcaguagcaaucgcaugguuacucggaagcagcaccagccaaaaagucaucuaucuaguaaugauccuacuaaucgccccggccuacuccauaagaugcaucggagucuccaacagagacuucguagaagggaugucaggcgggacaugggucgacgucguccucgagcacggagggugcgugaccgucauggcccaagacaaacccacagucgacauagaacucgucaccacgacagucagcaacauggcagaagugcgcuccuauugcuaugaagccagcauaagcgacauggccucggacucacgcugcccgacgcagggagaagccuacuuagacaaacaauccgacacccaauacgugugcaaacggacacucgucgaccgcggguggggaaacggaugcggacuguucggaaagggcagccuggucacaugcgccaaguuuaccugcagcaaaaagaugacuggaaaaagcauacagccagaaaaccucgaauaccgcaucaugcuaagcguacacgggagucaacacuccggcaugauaggauacgaaaccgacgaagaccgugccaaaguagaaguaacccccaacagcccccgcgccgaggccacccuaggaggcuucggcagccuaggacucgacugcgagccccgcaccggccuggacuucagcgaccucuacuaccucacaaugaacaacaagcacuggcuaguacacaaggaaugguuccacgacauaccgcuacccuggcacgcaggcgccgacacaggcacaccccacuggaacaacaaggaagcccugguagaguucaaagacgcccacgcaaaacgccaaacaguaguagucuugggcucgcaagaaggagccguacacacagcacuagccggagcacucgaagcagaaauggacggcgcaaaaggccgccuauucagcggccaccucaagugccgacucaaaauggacaaacuccgacuuaaaggagugucguacagccucugcaccgcggccuucaccuucaccaaaguacccgccgaaacacuacacgguacagucaccgucgaaguccaauacgcaggaacagacggaccaugcaaaauucccguccaaauggccgucgacaugcaaacccucaccccuguaggacgacucauaacagcaaacccaguaauaacugaaagcaccgaaaacagcaaaaugaugcuagaacuagacccacccuucggugacaguuauaucguaauaggagucggagacaagaaaaucacacaccacuggcaccgaucaggaucaacaauuggcaaagccuucgaagccacaguaaggggcgcgaaacgcauggccguacucggagacaccgccugggacuucggaucaguaggcggcgucuucaacucccucggaaaaggcauacaccaaauuuucggugccgcguucaagagccucuucggcggaauguccugguucagccaaauacuaaucggaacgcuccuagucuggcucggauuaaacaccaaaaacggaagcauaucccugaccugccucgcacucggaggaguuaugaucuuccucucaaccgcagucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11375 - RNA, 2293 nt, Artificial Sequence
  ZIKV (strain NatalRGN) ME variant mRNA Design 1 opt
gggagaaagcuuaccaugaacgaaggaagcauaauguggcuggcaucgcuagccguaguaauagcaugcgcaggcgcgguaacgcggcgggggucagccuacuacauguaccuagacagaaacgacgccggagaagccaucagcuuccccacaacacuaggaaugaacaaaugcuacauacaaauaauggaccuaggacacaugugcgacgcgacaauguccuacgagugcccgaugcuagacgaaggugucgaacccgacgacgucgacugcuggugcaacaccaccagcacauggguagucuacggcacaugccaccacaagaaaggagaagcacgacgcagccgccgcgcggucacccugccgagccacagcacacgaaaacugcaaacacggucacaaaccuggcuagaaagccgcgaguacacaaagcaccuuaucagaguagaaaacuggaucuuccgcaaucccggauucgcccuggcagcagccgccauagccuggcuacucggcucgagcaccagccaaaagguuaucuaccuagugaugauacuccucaucgcacccgcuuacuccauacguugcaucgggguaucaaaccgagacuucguagaaggcauguccggaggaaccugggucgacguaguucucgaacacggcgguugcgucacggucauggcucaggacaaaccaacagucgacaucgaacucgucaccacaaccgugagcaacauggccgaaguccgcaguuacugcuacgaggcaagcaucagcgacauggcaagcgacagccgaugccccacacaaggagaagcauaccuugacaaacagagcgacacccaauacgucugcaaacgaacauuggucgacagaggcuggggaaacggaugcggacuauucggaaaaggaagccuaguaaccugcgcaaaauucgccugcucaaagaaaaugaccgggaaaagcauacaacccgaaaaccuagaguaccgcauaaugcugagcguccacggcucacaacacuccggcaugauagucaacgacacgggccacgaaacagacgagaacagagccaaaguagaaaucacaccaaacagcccacgcgcagaagcaacccuaggagguuucgggagcuuaggacucgacugugaaccccgaaccggacucgacuucagcgaccuguacuaccucaccaugaacaacaaacacuggcuaguacacaaagaaugguuccacgacauaccacucccauggcacgccggggcagacacagguaccccgcacuggaacaacaaggaagcccuggucgaguucaaagacgcacacgcaaaaagacaaaccgucgugguacuaggaucacaagaaggagcgguccacacagcacucgccggagcgcuugaagcggaaauggacggagcaaaaggccgacucaguagcgggcaccuaaagugccggcuaaaaauggacaaacuccgacuaaaaggagucucauacucgcuaugcaccgccgccuucacguucacaaaaaucccagcugaaacccugcacggcaccguaaccguagagguccaauacgcaggaacugacgggccaugcaaaguacccgcacaaauggcagucgacaugcaaacacuaaccccuguaggccgccucauaacagcaaauccaguaaucaccgaaucaaccgaaaacagcaaaaugauguuagaacucgacccaccguucggcgacagcuacauagucauaggugucggcgagaaaaagaucacccaccacuggcaccgaucgggcucgaccaucggcaaagcauuugaagcuacaguacgaggcgcgaaacgaauggcgguccucggugacacagccugggacuucggaucaguaggcggggcacucaauuccuugggaaaaggaauccaccagaucuucggagcagcauucaaaucccuuuucgggggcaugagcugguucucccaaauacuaauaggcacacugcuaauguggcuaggacucaacaccaaaaacggcagcaucucccugaugugccucgcacuagguggcguacucaucuuccucuccacagcagucuccgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11376 - RNA, 2485 nt, Artificial Sequence
  ZIKV (strain ZikaSPH2015) prME-short variant mRNA Design 2 wild type
ggggcgcugccuacggagguggcagccaucuccuucucggcaucaagcuuaccaugggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11377 - RNA, 2485 nt, Artificial Sequence
  ZIKV (isolate Z1106033) prME-short variant mRNA Design 2 wild type
ggggcgcugccuacggagguggcagccaucuccuucucggcaucaagcuuaccaugggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11378 - RNA, 2473 nt, Artificial Sequence
  ZIKV (strain MR 766) prME-short variant mRNA Design 2 wild type
ggggcgcugccuacggagguggcagccaucuccuucucggcaucaagcuuaccaugggcagaaagcaaaacaaaagaggaggaaaugaaggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11379 - RNA, 2485 nt, Artificial Sequence
  ZIKV (strain NatalRGN) prME-short variant mRNA Design 2 wild type
ggggcgcugccuacggagguggcagccaucuccuucucggcaucaagcuuaccaugggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11380 - RNA, 2458 nt, Artificial Sequence
  ZIKV (strain ZikaSPH2015) prME-short variant mRNA Design 2 wild type
ggggcgcugccuacggagguggcagccaucuccuucucggcaucaagcuuaccaugaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11381 - RNA, 2458 nt, Artificial Sequence
  ZIKV (isolate Z1106033) prME-short variant mRNA Design 2 wild type
ggggcgcugccuacggagguggcagccaucuccuucucggcaucaagcuuaccaugaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11382 - RNA, 2446 nt, Artificial Sequence
  ZIKV (strain MR 766) prME-short variant mRNA Design 2 wild type
ggggcgcugccuacggagguggcagccaucuccuucucggcaucaagcuuaccaugaaugaaggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11383 - RNA, 2458 nt, Artificial Sequence
  ZIKV (strain NatalRGN) prME-short variant mRNA Design 2 wild type
ggggcgcugccuacggagguggcagccaucuccuucucggcaucaagcuuaccaugaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11384 - RNA, 2485 nt, Artificial Sequence
  ZIKV (strain ZikaSPH2015) prME-short variant mRNA Design 2 wild type
ggggcgcugccuacggagguggcagccaucuccuucucggcaucaagcuuaccaugggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11385 - RNA, 2485 nt, Artificial Sequence
  ZIKV (isolate Z1106033) prME-short variant mRNA Design 2 wild type
ggggcgcugccuacggagguggcagccaucuccuucucggcaucaagcuuaccaugggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11386 - RNA, 2473 nt, Artificial Sequence
  ZIKV (strain MR 766) prME-short variant mRNA Design 2 wild type
ggggcgcugccuacggagguggcagccaucuccuucucggcaucaagcuuaccaugggcagaaagcaaaacaaaagaggaggaaaugaaggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11387 - RNA, 2485 nt, Artificial Sequence
  ZIKV (strain NatalRGN) prME-short variant mRNA Design 2 wild type
ggggcgcugccuacggagguggcagccaucuccuucucggcaucaagcuuaccaugggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11388 - RNA, 2458 nt, Artificial Sequence
  ZIKV (strain ZikaSPH2015) prME-short variant mRNA Design 2 wild type
ggggcgcugccuacggagguggcagccaucuccuucucggcaucaagcuuaccaugaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11389 - RNA, 2458 nt, Artificial Sequence
  ZIKV (isolate Z1106033) prME-short variant mRNA Design 2 wild type
ggggcgcugccuacggagguggcagccaucuccuucucggcaucaagcuuaccaugaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11390 - RNA, 2446 nt, Artificial Sequence
  ZIKV (strain MR 766) prME-short variant mRNA Design 2 wild type
ggggcgcugccuacggagguggcagccaucuccuucucggcaucaagcuuaccaugaaugaaggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11391 - RNA, 2458 nt, Artificial Sequence
  ZIKV (strain NatalRGN) prME-short variant mRNA Design 2 wild type
ggggcgcugccuacggagguggcagccaucuccuucucggcaucaagcuuaccaugaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11392 - RNA, 2485 nt, Artificial Sequence; identical to SEQ ID NO: 11376
  ZIKV (strain ZikaSPH2015) ME variant mRNA Design 2 wild type

SEQ ID NO: 11393 - RNA, 2485 nt, Artificial Sequence; identical to SEQ ID NO: 11377
  ZIKV (isolate Z1106033) ME variant mRNA Design 2 wild type

SEQ ID NO: 11394 - RNA, 2473 nt, Artificial Sequence; identical to SEQ ID NO: 11378
  ZIKV (strain MR 766) ME variant mRNA Design 2 wild type

SEQ ID NO: 11395 - RNA, 2485 nt, Artificial Sequence; identical to SEQ ID NO: 11379
  ZIKV (strain NatalRGN) ME variant mRNA Design 2 wild type

SEQ ID NO: 11396 - RNA, 2458 nt, Artificial Sequence; identical to SEQ ID NO: 11380
  ZIKV (strain ZikaSPH2015) ME variant mRNA Design 2 wild type

SEQ ID NO: 11397 - RNA, 2458 nt, Artificial Sequence; identical to SEQ ID NO: 11381
  ZIKV (isolate Z1106033) ME variant mRNA Design 2 wild type

SEQ ID NO: 11398 - RNA, 2446 nt, Artificial Sequence; identical to SEQ ID NO: 11382
  ZIKV (strain MR 766) ME variant mRNA Design 2 wild type

SEQ ID NO: 11399 - RNA, 2458 nt, Artificial Sequence; identical to SEQ ID NO: 11383
  ZIKV (strain NatalRGN) ME variant mRNA Design 2 wild type

SEQ ID NO: 11400 - RNA, 2485 nt, Artificial Sequence
  ZIKV (strain ZikaSPH2015) prME-short variant mRNA Design 2 opt
ggggcgcugccuacggagguggcagccaucuccuucucggcaucaagcuuaccaugggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11401 - RNA, 2485 nt, Artificial Sequence
  ZIKV (isolate Z1106033) prME-short variant mRNA Design 2 opt
ggggcgcugccuacggagguggcagccaucuccuucucggcaucaagcuuaccaugggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11402 - RNA, 2473 nt, Artificial Sequence
  ZIKV (strain MR 766) prME-short variant mRNA Design 2 opt
ggggcgcugccuacggagguggcagccaucuccuucucggcaucaagcuuaccaugggccggaagcagaacaagcgcgggggcaacgaggggagcaucauguggcuggccucccucgccguggucaucgcgugcgccggcgccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11403 - RNA, 2485 nt, Artificial Sequence
  ZIKV (strain NatalRGN) prME-short variant mRNA Design 2 opt
ggggcgcugccuacggagguggcagccaucuccuucucggcaucaagcuuaccaugggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11404 - RNA, 2458 nt, Artificial Sequence
  ZIKV (strain ZikaSPH2015) prME-short variant mRNA Design 2 opt
ggggcgcugccuacggagguggcagccaucuccuucucggcaucaagcuuaccaugaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11405 - RNA, 2458 nt, Artificial Sequence
  ZIKV (isolate Z1106033) prME-short variant mRNA Design 2 opt
ggggcgcugccuacggagguggcagccaucuccuucucggcaucaagcuuaccaugaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11406 - RNA, 2446 nt, Artificial Sequence
  ZIKV (strain MR 766) prME-short variant mRNA Design 2 opt
ggggcgcugccuacggagguggcagccaucuccuucucggcaucaagcuuaccaugaacgagggcagcaucauguggcuggccucccucgccguggucaucgcgugcgccggggccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11407 - RNA, 2458 nt, Artificial Sequence
  ZIKV (strain NatalRGN) prME-short variant mRNA Design 2 opt
ggggcgcugccuacggagguggcagccaucuccuucucggcaucaagcuuaccaugaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11408 - RNA, 2485 nt, Artificial Sequence
  ZIKV (strain ZikaSPH2015) prME-short variant mRNA Design 2 opt
ggggcgcugccuacggagguggcagccaucuccuucucggcaucaagcuuaccaugggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11409 - RNA, 2485 nt, Artificial Sequence
  ZIKV (isolate Z1106033) prME-short variant mRNA Design 2 opt
ggggcgcugccuacggagguggcagccaucuccuucucggcaucaagcuuaccaugggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11410 - RNA, 2473 nt, Artificial Sequence
  ZIKV (strain MR 766) prME-short variant mRNA Design 2 opt
ggggcgcugccuacggagguggcagccaucuccuucucggcaucaagcuuaccaugggccggaagcagaacaagcgcgggggcaacgaggggagcaucauguggcuggccucccucgccguggucaucgcgugcgccggcgccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11411 - RNA, 2485 nt, Artificial Sequence
  ZIKV (strain NatalRGN) prME-short variant mRNA Design 2 opt
ggggcgcugccuacggagguggcagccaucuccuucucggcaucaagcuuaccaugggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11412 - RNA, 2458 nt, Artificial Sequence
  ZIKV (strain ZikaSPH2015) prME-short variant mRNA Design 2 opt
ggggcgcugccuacggagguggcagccaucuccuucucggcaucaagcuuaccaugaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11413 - RNA, 2458 nt, Artificial Sequence
  ZIKV (isolate Z1106033) prME-short variant mRNA Design 2 opt
ggggcgcugccuacggagguggcagccaucuccuucucggcaucaagcuuaccaugaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11414 - RNA, 2446 nt, Artificial Sequence
  ZIKV (strain MR 766) prME-short variant mRNA Design 2 opt
ggggcgcugccuacggagguggcagccaucuccuucucggcaucaagcuuaccaugaacgagggcagcaucauguggcuggccucccucgccguggucaucgcgugcgccggggccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11415 - RNA, 2458 nt, Artificial Sequence
  ZIKV (strain NatalRGN) prME-short variant mRNA Design 2 opt
ggggcgcugccuacggagguggcagccaucuccuucucggcaucaagcuuaccaugaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11416 - RNA, 2485 nt, Artificial Sequence; identical to SEQ ID NO: 11400
  ZIKV (strain ZikaSPH2015) ME variant mRNA Design 2 opt

SEQ ID NO: 11417 - RNA, 2485 nt, Artificial Sequence; identical to SEQ ID NO: 11401
  ZIKV (isolate Z1106033) ME variant mRNA Design 2 opt

SEQ ID NO: 11418 - RNA, 2473 nt, Artificial Sequence; identical to SEQ ID NO: 11402
  ZIKV (strain MR 766) ME variant mRNA Design 2 opt

SEQ ID NO: 11419 - RNA, 2485 nt, Artificial Sequence; identical to SEQ ID NO: 11403
  ZIKV (strain NatalRGN) ME variant mRNA Design 2 opt

SEQ ID NO: 11420 - RNA, 2458 nt, Artificial Sequence; identical to SEQ ID NO: 11404
  ZIKV (strain ZikaSPH2015) ME variant mRNA Design 2 opt

SEQ ID NO: 11421 - RNA, 2458 nt, Artificial Sequence; identical to SEQ ID NO: 11405
  ZIKV (isolate Z1106033) ME variant mRNA Design 2 opt

SEQ ID NO: 11422 - RNA, 2446 nt, Artificial Sequence; identical to SEQ ID NO: 11406
  ZIKV (strain MR 766) ME variant mRNA Design 2 opt

SEQ ID NO: 11423 - RNA, 2458 nt, Artificial Sequence; identical to SEQ ID NO: 11407
  ZIKV (strain NatalRGN) ME variant mRNA Design 2 opt

SEQ ID NO: 11424 - RNA, 2485 nt, Artificial Sequence
  ZIKV (strain ZikaSPH2015) prME-short variant mRNA Design 2 opt
ggggcgcugccuacggagguggcagccaucuccuucucggcaucaagcuuaccaugggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11425 - RNA, 2485 nt, Artificial Sequence
  ZIKV (isolate Z1106033) prME-short variant mRNA Design 2 opt
ggggcgcugccuacggagguggcagccaucuccuucucggcaucaagcuuaccaugggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11426 - RNA, 2473 nt, Artificial Sequence
  ZIKV (strain MR 766) prME-short variant mRNA Design 2 opt
ggggcgcugccuacggagguggcagccaucuccuucucggcaucaagcuuaccaugggccgcaagcagaacaagcgcggcggcaacgagggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11427 - RNA, 2485 nt, Artificial Sequence
  ZIKV (strain NatalRGN) prME-short variant mRNA Design 2 opt
ggggcgcugccuacggagguggcagccaucuccuucucggcaucaagcuuaccaugggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11428 - RNA, 2458 nt, Artificial Sequence
  ZIKV (strain ZikaSPH2015) prME-short variant mRNA Design 2 opt
ggggcgcugccuacggagguggcagccaucuccuucucggcaucaagcuuaccaugaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11429 - RNA, 2458 nt, Artificial Sequence
  ZIKV (isolate Z1106033) prME-short variant mRNA Design 2 opt
ggggcgcugccuacggagguggcagccaucuccuucucggcaucaagcuuaccaugaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11430 - RNA, 2446 nt, Artificial Sequence
  ZIKV (strain MR 766) prME-short variant mRNA Design 2 opt
ggggcgcugccuacggagguggcagccaucuccuucucggcaucaagcuuaccaugaacgagggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11431 - RNA, 2458 nt, Artificial Sequence
  ZIKV (strain NatalRGN) prME-short variant mRNA Design 2 opt
ggggcgcugccuacggagguggcagccaucuccuucucggcaucaagcuuaccaugaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11432 - RNA, 2485 nt, Artificial Sequence
  ZIKV (strain ZikaSPH2015) prME-short variant mRNA Design 2 opt
ggggcgcugccuacggagguggcagccaucuccuucucggcaucaagcuuaccaugggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11433 - RNA, 2485 nt, Artificial Sequence
  ZIKV (isolate Z1106033) prME-short variant mRNA Design 2 opt
ggggcgcugccuacggagguggcagccaucuccuucucggcaucaagcuuaccaugggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11434 - RNA, 2473 nt, Artificial Sequence
  ZIKV (strain MR 766) prME-short variant mRNA Design 2 opt
ggggcgcugccuacggagguggcagccaucuccuucucggcaucaagcuuaccaugggccgcaagcagaacaagcgcggcggcaacgagggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11435 - RNA, 2485 nt, Artificial Sequence
  ZIKV (strain NatalRGN) prME-short variant mRNA Design 2 opt
ggggcgcugccuacggagguggcagccaucuccuucucggcaucaagcuuaccaugggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11436 - RNA, 2458 nt, Artificial Sequence
  ZIKV (strain ZikaSPH2015) prME-short variant mRNA Design 2 opt
ggggcgcugccuacggagguggcagccaucuccuucucggcaucaagcuuaccaugaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11437 - RNA, 2458 nt, Artificial Sequence
  ZIKV (isolate Z1106033) prME-short variant mRNA Design 2 opt
ggggcgcugccuacggagguggcagccaucuccuucucggcaucaagcuuaccaugaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11438 - RNA, 2446 nt, Artificial Sequence
  ZIKV (strain MR 766) prME-short variant mRNA Design 2 opt
ggggcgcugccuacggagguggcagccaucuccuucucggcaucaagcuuaccaugaacgagggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11439 - RNA, 2458 nt, Artificial Sequence
  ZIKV (strain NatalRGN) prME-short variant mRNA Design 2 opt
ggggcgcugccuacggagguggcagccaucuccuucucggcaucaagcuuaccaugaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11440 - RNA, 2485 nt, Artificial Sequence; identical to SEQ ID NO: 11424
  ZIKV (strain ZikaSPH2015) ME variant mRNA Design 2 opt

SEQ ID NO: 11441 - RNA, 2485 nt, Artificial Sequence; identical to SEQ ID NO: 11425
  ZIKV (isolate Z1106033) ME variant mRNA Design 2 opt

SEQ ID NO: 11442 - RNA, 2473 nt, Artificial Sequence; identical to SEQ ID NO: 11426
  ZIKV (strain MR 766) ME variant mRNA Design 2 opt

SEQ ID NO: 11443 - RNA, 2485 nt, Artificial Sequence; identical to SEQ ID NO: 11427
  ZIKV (strain NatalRGN) ME variant mRNA Design 2 opt

SEQ ID NO: 11444 - RNA, 2458 nt, Artificial Sequence; identical to SEQ ID NO: 11428
  ZIKV (strain ZikaSPH2015) ME variant mRNA Design 2 opt

SEQ ID NO: 11445 - RNA, 2458 nt, Artificial Sequence; identical to SEQ ID NO: 11429
  ZIKV (isolate Z1106033) ME variant mRNA Design 2 opt

SEQ ID NO: 11446 - RNA, 2446 nt, Artificial Sequence; identical to SEQ ID NO: 11430
  ZIKV (strain MR 766) ME variant mRNA Design 2 opt

SEQ ID NO: 11447 - RNA, 2458 nt, Artificial Sequence; identical to SEQ ID NO: 11431
  ZIKV (strain NatalRGN) ME variant mRNA Design 2 opt

SEQ ID NO: 11448 - RNA, 2485 nt, Artificial Sequence
  ZIKV (strain ZikaSPH2015) prME-short variant mRNA Design 2 opt
ggggcgcugccuacggagguggcagccaucuccuucucggcaucaagcuuaccaugggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacaugugcgaugccacgaugaguuacgaguguccuauguuagacgaagggguggagccagaugacguagauugcugguguaacaccacaagcacuuggguggucuauggaaccugccaucacaaaaagggcgaagcucguagauccaggcgggcagugacacugccgucucauucgacccgcaaacuacagacuagaucacagacauggcucgagagcagggaguacaccaagcaccugauccggguugaaaauuggauuuuucgcaaccccggcuucgcccuugcugccgcggcaaucgccuggcuguuggggaguuccacgucucagaaggugauauaucucgucaugauccugcugauugcuccugccuacagcauccgauguauuggaguguccaauagagacuuuguagaggguaugucaggcgggacuuggguugauaucgugcucgaacauggaggcugcgucaccgugauggcacaagacaaaccaacaguggauauagaguuagucacuaccacaguuaguaacauggcugaggugaggagcuacuguuaugaagccucuauuuccgacauggcgucagauagccggugccccacccagggugaggccuaccuggacaagcagagugacacgcaguauguauguaaacguacucuuguggaucgcggguggggaaauggcugcggcuuguucgggaagggaucucuggucacaugcgcaaaauuugcuuguuccaagaagaugaccgguaaaagcauccaaccugaaaaccuagaguacagaauuaugcucucggugcacggcucucagcacuccgggaugaucguuaaugacacuggacaugaaacagaugagaacagggccaagguggagaucaccccaaauucaccccgggcugaagccacgcugggcgguuucgggagucuuggccuggacugcgagccucgaaccggauuggauuuuagcgaccucuauuaccugacaaugaacaauaaacacugguuaguccauaaggaaugguuccacgauauuccacugccguggcacgcaggcgccgacacugggacaccccauuggaacaacaaagaggcucucguggaauuuaaggaugcgcacgcaaaacgccagaccguaguugugcuuggaucccaggagggugccguccauacugcucuggccggcgcauuggaggccgaaauggacggggcuaagggaagacuaucuagcggccaccugaaguguaggcucaaaauggauaagcugcggcuuaaaggugugucauauagucugugcaccgccgcauucacauuuaccaagauaccugcggagacuuugcaugggacggucacaguggaaguucaauacgcuggcaccgacggaccauguaaagugcccgcccagauggcaguagacaugcagacucucaccccugucggccgccugaucacagccaauccagugauuaccgaguccacugaaaacagcaagaugauguuagagcuggaucccccguucggggacucuuacaucguuauaggagugggugagaagaaaauuacacaccacuggcauagaucaggcaguacgaucgggaaggcuuuugaagccaccgucaggggagcaaaacguauggcugugcuaggcgauacugccugggacuucgguagcguagggggcgcgcucaauucccugggaaagggcauccaccaaauuuucggggccgcuuuuaaaucucuuuucggaggcaugucgugguuuagccagaucuugauugguacacugcucauguggcuggggcuuaacaccaagaauggauccauaucacugaugugcuuggcacucggcggugugcugaucuucuuaaguacagccguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11449 - RNA, 2485 nt, Artificial Sequence
  ZIKV (isolate Z1106033) prME-short variant mRNA Design 2 opt
ggggcgcugccuacggagguggcagccaucuccuucucggcaucaagcuuaccaugggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacacgugcgaugccaccaugaguuacgaguguccuauguuagacgaagggguggagccagaugacguagauugcugguguaacacaacuagcaccuggguggucuauggaacaugccaucacaaaaagggcgaagcucguagauccaggcgggcagugacccugccgucucauucgacucgcaaacuacagacaagaucacagaccuggcucgagagcagggaguacacgaagcaccugauccggguugaaaauuggauuuuucgcaaccccggcuucgcccuugcugccgcggcaaucgccuggcuguuggggaguuccacuucucagaaggugauauaucucgucaugauccugcugauugcuccugccuacagcauccgauguauuggaguguccaauagagacuuuguagaggguaugucaggcgggaccuggguugaugugguccucgaacauggaggcugcgugacagugauggcacaagacaaaccaacugucgauaucgaguuaguuaccacaaccgugaguaacauggcugagguaaggagcuacuguuaugaagccucuauauccgacauggcgucagauagccggugccccacgcagggugaggccuaccuggacaagcagagugacacucaguauguguguaaacguacacuugucgaucgcggguggggaaauggcugcggcuuguucgggaagggaucucuggugaccugcgcaaaauuugcuuguuccaagaagaugacugguaaaagcauucaaccugaaaaccuagaguacagaaucaugcucucgguucacggcucucagcacuccgggaugauugugaaugacacaggacaugaaaccgaugagaacagggccaaggucgagaucacgccaaauucaccccgggcugaagccacccugggcgguuucgggagucuuggccuggacugcgagccucgaacaggauuggauuuuagcgaccucuauuaccugacuaugaacaauaaacacugguuagugcauaaggaaugguuccacgauaucccacugccguggcacgcaggcgccgacaccgggacaccccauuggaacaacaaagaggcucucguagaauuuaaggaugcgcacgcaaaacgccagacuguugugguccuuggaucccaggagggugccgugcauaccgcucuggccggcgcauuggaggccgaaauggacggggcuaagggaagacuaucuagcggccaccugaaguguaggcucaaaauggauaagcugcggcuuaaaggugucucauauagucugugcacagccgcauucaccuuuacuaagauuccugcggagacguugcaugggacagugaccguugaagugcaauacgcuggcacugacggaccauguaaaguacccgcccagauggcagucgacaugcagacccucacaccugugggccgccugauaaccgccaauccaguuaucacugaguccacagaaaacagcaagaugauguuagagcuggaucccccguucggggacucuuacauugugaucggagucggugagaagaaaauaacgcaccacuggcauagaucaggcaguaccauugggaaggcuuuugaagccacugugaggggagcaaaacguauggcuguacuaggcgauacagccugggacuucgguagcguugggggcgcgcucaauucccugggaaagggcauccaccaaaucuucggggccgcuuuuaaaucucuuuucggaggcaugucgugguuuagccagauuuugaucgguacccugcucauguggcuggggcuuaacgcaaagaauggauccauuucacugaugugcuuggcccucggcggugugcugauauucuuaaguacagcugucucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11450 - RNA, 2473 nt, Artificial Sequence
  ZIKV (strain MR 766) prME-short variant mRNA Design 2 opt
ggggcgcugccuacggagguggcagccaucuccuucucggcaucaagcuuaccaugggcagaaagcagaacaaaaggggagggaaugaggguagcaucauguggcuggccucccucgcuguggucauugcaugcgccggcgcgauaacccggcgcgggucugcuuacuauauguaccuugaccgaucagaugccggaaaggcaaucaguuucgccacaacucugggcguuaacaaaugucacgugcaaauuauggacuugggucauaugugcgaugcuacgaugagcuaugaaugucccauguuagacgaggggguagaaccugaugacguggauugcugguguaauaccacauccacuugggucguguacggaaccugccaccauaagaaaggcgaggcacguagaucuaggcgggccguuacacugccaucgcacucaacccgcaagcuacagacuagaagccagacauggcucgaaaguagggaguauaccaagcaucugaucaaaguggagaacuggauuuuucggaauccgggcuucgcucuugucgccguggcgaucgcauggcuguugggguccucuacgagccagaagguaauauaccucguuaugauccugcugauugcccccgcuuauuccauccgcuguauuggagugucaaaccgagacuuugucgaagguaugaguggcgggacuuggguggaugugguccucgagcacggaggcugcguuaccgugauggcccaagacaaaccuacaguagauaucgaauuagugacuaccacagucagcaauauggcagaggugagaucuuacuguuacgaggcuuccauaucagacauggccagcgauaguaggugcccaacccagggugaagcguaucuggacaagcagucugacacgcaguacguuuguaaacggacucuuguggaucguggguggggaaacggcugcggcuuguucgggaagggaucccuggucacaugcgccaaguuuaccuguagcaaaaagaugacugguaaaucgauucaacccgagaaucuagaauaucgcaucaugcucucugugcacggcucccagcauucagggaugauuggauacgagacagacgaagauagagcaaagguagagguuaccccuaacaguccaagggcugaggccacgcugggcgguuucgggagccuuggccuggacugcgaaccccggaccggauuggauuuuuccgaccucuauuaccugacaaugaauaacaaacacugguuagugcauaaggagugguuccacgauaucccucugccauggcacgcuggcgccgacacugggaccccgcauuggaauaacaaagaagcacucgucgaguuuaaggaugcccacgcuaagcgacagacaguggucgugcuuggaucucaggaaggugcgguucauacugcacuggccggcgcuuuggaggccgagauggacggggcaaaaggacgccuauucagcggccaccugaaguguagacucaaaauggauaagcugaggcuuaaaggugugucauauagucugugcaccgccgcuuuuacauucaccaagguacccgccgaaacuuugcaugggacggucacaguggagguucaauacgcaggcaccgacggaccuuguaagaucccagugcagauggcggucgacaugcagacucucacccccgugggccggcugauuacagcuaauccuguaauaaccgaauccacugagaacagcaaaaugauguuagaacuggauccacccuuuggggacucuuacaucgugauuggaguuggugauaagaaaaucacacaccacuggcaucgcucaggcaguacgauagggaaggccuucgaggcaaccgucagaggagccaaaaggauggcugugcuaggcgacacugccugggauuucgguagcgucgggggcguguuuaacucccucggaaagggcauucaccaaaucuucggggcagcuuuuaagucucuguucggaggcaugucgugguuuagccagauccuuauugguacauugcugguuuggcucgggcugaauaccaaaaacggauccaucucacuuacaugccuggccuugggcggugugaugauuuuccucaguacugcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11451 - RNA, 2485 nt, Artificial Sequence
  ZIKV (strain NatalRGN) prME-short variant mRNA Design 2 opt
ggggcgcugccuacggagguggcagccaucuccuucucggcaucaagcuuaccaugggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacaugugcgaugccacgaugaguuacgaguguccuauguuagacgaagggguggagccagaugacguagauugcugguguaacaccacaagcacuuggguggucuauggaaccugccaucacaaaaagggcgaagcucguagauccaggcgggcagugacacugccgucucauucgacccgcaaacuacagacuagaucacagacauggcucgagagcagggaguacaccaagcaccugauccggguugaaaauuggauuuuucgcaaccccggcuucgcccuugcugccgcggcaaucgccuggcuguuggggaguuccacgucucagaaggugauauaucucgucaugauccugcugauugcuccugccuacagcauccgauguauuggaguguccaauagagacuuuguagaggguaugucaggcgggacuuggguugaugugguccucgaacauggaggcugcgugaccgugauggcacaagacaaaccaacagucgauaucgaguuaguuacuaccacagugaguaacauggcugagguaaggagcuacuguuaugaagccucuauauccgacauggcgucagauagccggugccccacccagggugaggccuaccuggacaagcagagugacacgcaguauguguguaaacguacucuugucgaucgcggguggggaaauggcugcggcuuguucgggaagggaucucuggugacaugcgcaaaauuugcuuguuccaagaagaugaccgguaaaagcauucaaccugaaaaccuagaguacagaaucaugcucucgguucacggcucucagcacuccgggaugauugugaaugacacuggacaugaaacagaugagaacagggccaaggucgagaucaccccaaauucaccccgggcugaagccacgcugggcgguuucgggagucuuggccuggacugcgagccucgaaccggauuggauuuuagcgaccucuauuaccugacaaugaacaauaaacacugguuagugcauaaggaaugguuccacgauaucccacugccguggcacgcaggcgccgacacugggacaccccauuggaacaacaaagaggcucucguagaauuuaaggaugcgcacgcaaaacgccagaccguugugguccuuggaucccaggagggugccgugcauacugcucuggccggcgcauuggaggccgaaauggacggggcuaagggaagacuaucuagcggccaccugaaguguaggcucaaaauggauaagcugcggcuuaaaggugucucauauagucugugcaccgccgcauucacauuuaccaagauuccugcggagacuuugcaugggacggugacaguugaagugcaauacgcuggcaccgacggaccauguaaaguacccgcccagauggcagucgacaugcagacucucaccccugugggccgccugauaacagccaauccaguuaucaccgaguccacugaaaacagcaagaugauguuagagcuggaucccccguucggggacucuuacauugugaucggagucggugagaagaaaauaacacaccacuggcauagaucaggcaguacgauugggaaggcuuuugaagccaccgugaggggagcaaaacguauggcuguacuaggcgauacugccugggacuucgguagcguugggggcgcgcucaauucccugggaaagggcauccaccaaaucuucggggccgcuuuuaaaucucuuuucggaggcaugucgugguuuagccagauuuugaucgguacacugcucauguggcuggggcuuaacaccaagaauggauccauuucacugaugugcuuggcacucggcggugugcugauauucuuaaguacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11452 - RNA, 2458 nt, Artificial Sequence
  ZIKV (strain ZikaSPH2015) prME-short variant mRNA Design 2 opt
ggggcgcugccuacggagguggcagccaucuccuucucggcaucaagcuuaccaugaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacaugugcgaugccacgaugaguuacgaguguccuauguuagacgaaggaguggagccagaugacguagauugcugguguaauaccacaagcacuuggguggucuaugguaccugccaucacaaaaagggcgaagcucgccgaucccguagagcagugacacugccgucucauucgaccaggaaacuacaaacucggucacagacauggcucgagagccgcgaguacaccaagcaccugaucagaguugaaaacuggauuuuuaggaaucccggguucgcccuugcugccgcggcaaucgccuggcuguugggaaguuccacgucucagaaagugauauaucucgucaugauccugcugauugcuccugccuacagcauccgguguauuggcguguccaaccgcgacuuuguagagggcaugucagggggaacuuggguugauaucgugcucgaacaugguggcugcgucaccgugauggcacaggacaagccaacaguggauauagaguuagucacuaccacaguuaguaauauggcugaggugcgaagcuacuguuaugaagccucuauuuccgacauggcgucagauagcagaugccccacccaaggggaggccuaccuggacaagcagagugacacgcaguauguauguaaaaggacucuuguggaucggggauggggcaacgguugcggguuguucggaaagggcucucuggucacaugcgcaaaauuugcuuguuccaagaaaaugaccggcaagagcauccagccugaaaaucuagaguaccguauuaugcucucggugcacgggucucaacacuccggaaugaucguuaacgacacuggucaugaaacagaugagaaucgcgccaagguggagaucaccccaaacucacccagagcugaagccacgcugggcggguucggaagucuuggccuggacugcgagccuaggaccgguuuggauuuuagcgaccucuauuaccugacaaugaauaacaaacacugguuaguccauaaggaaugguuccacgauauuccacugccguggcacgcaggggccgacacuggcacaccccauuggaauaacaaagaggcucucguggaauuuaaggaugcgcacgcaaaacggcagaccguaguugugcuuggaucccaggagggcgccguccauacugcucuggccggggcauuggaggccgaaauggacggagcuaagggucgacuaucuagcggccaccugaaaugucgccucaagauggauaagcugagacuuaaaggggugucauauagucugugcaccgccgcauucacauuuaccaagauaccugcggagacuuugcauggaacggucacaguggaaguucaguacgcuggcaccgacgguccauguaaagugcccgcccaaauggcaguagacaugcagacucucaccccugucgggaggcugaucacagccaacccagugauuaccgaguccacugaaaauagcaagaugauguuagagcuggaucccccguucggcgacucuuacaucguuauaggagugggcgagaaaaagauuacacaccacuggcaucggucagggaguacgaucggaaaggcuuuugaagccaccguccgcggugcaaaaagaauggcugugcuaggcgauacugccugggacuucgggagcguaggaggcgcgcucaacucccuggguaaggggauccaccagauuuucggcgccgcuuuuaaaucucuuuucggaggcaugucgugguuuagccaaaucuugauugggacacugcucauguggcugggacuuaauaccaagaacggcuccauaucacugaugugcuuggcacucgguggggugcugaucuucuuaaguacagccguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11453 - RNA, 2458 nt, Artificial Sequence
  ZIKV (isolate Z1106033) prME-short variant mRNA Design 2 opt
ggggcgcugccuacggagguggcagccaucuccuucucggcaucaagcuuaccaugaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacacgugcgaugccaccaugaguuacgaguguccuauguuagacgaaggaguggagccagaugacguagauugcugguguaauacaacuagcaccuggguggucuauggcacaugccaucacaaaaagggugaagcucgccgaucccguagagcagugacccugccgucucauucgacuaggaaacuacaaacacggucacagaccuggcucgagagccgcgaguacacgaagcaccugaucagaguugaaaacuggauuuuuaggaaucccggguucgcccuugcugccgcggcaaucgccuggcuguugggaaguuccacuucucagaaagugauauaucucgucaugauccugcugauugcuccugccuacagcauccgguguauuggcguguccaaccgcgacuuuguagagggcaugucagggggaaccuggguugaugugguccucgaacaugguggcugcgugacagugauggcacaggacaagccaacugucgauaucgaguuaguuaccacaaccgugaguaauauggcugagguacgaagcuacuguuaugaagccucuauauccgacauggcgucagauagcagaugccccacgcaaggggaggccuaccuggacaagcagagugacacucaguauguguguaaaaggacacuugucgaucggggauggggcaacgguugcggguuguucggaaagggcucucuggugaccugcgcaaaauuugcuuguuccaagaaaaugacuggcaagagcauucagccugaaaaucuagaguaccguaucaugcucucgguucacgggucucaacacuccggaaugauugugaacgacacaggucaugaaaccgaugagaaucgcgccaaggucgagaucacgccaaacucacccagagcugaagccacccugggcggguucggaagucuuggccuggacugcgagccuaggacagguuuggauuuuagcgaccucuauuaccugacuaugaauaacaaacacugguuagugcauaaggaaugguuccacgauaucccacugccguggcacgcaggggccgacaccggcacaccccauuggaauaacaaagaggcucucguagaauuuaaggaugcgcacgcaaaacggcagacuguugugguccuuggaucccaggagggcgccgugcauaccgcucuggccggggcauuggaggccgaaauggacggagcuaagggucgacuaucuagcggccaccugaaaugucgccucaagauggauaagcugagacuuaaaggggucucauauagucugugcacagccgcauucaccuuuacuaagauuccugcggagacguugcauggaacagugaccguugaagugcaguacgcuggcacugacgguccauguaaaguacccgcccaaauggcagucgacaugcagacccucacaccuguggggaggcugauaaccgccaacccaguuaucacugaguccacagaaaauagcaagaugauguuagagcuggaucccccguucggcgacucuuacauugugaucggagucggcgagaaaaagauaacgcaccacuggcaucggucagggaguaccauuggaaaggcuuuugaagccacugugcgcggugcaaaaagaauggcuguacuaggcgauacagccugggacuucgggagcgugggaggcgcgcucaacucccuggguaaggggauccaccagaucuucggcgccgcuuuuaaaucucuuuucggaggcaugucgugguuuagccaaauuuugaucgggacccugcucauguggcugggacuuaaugcaaagaacggcuccauuucacugaugugcuuggcccucggugggguucugauauucuuaaguacagcugucucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11454 - RNA, 2446 nt, Artificial Sequence
  ZIKV (strain MR 766) prME-short variant mRNA Design 2 opt
ggggcgcugccuacggagguggcagccaucuccuucucggcaucaagcuuaccaugaacgagggcagcaucauguggcuggccucccucgcuguggucauugcaugcgccggggcgauaaccagaaggggaucugcuuacuauauguaccuugaccggucagaugccgguaaggcaaucaguuucgccacaacucugggcguuaauaaaugucacgugcagauuauggacuuggggcauaugugcgaugcuacgaugagcuaugaaugucccauguuagacgagggaguagaaccugaugacguggauugcugguguaacaccacauccacuugggucguguacgguaccugccaccauaagaaaggcgaggcacgccgaucucguagagccguuacacugccaucgcacucaaccaggaagcuacaaacucggagccagacauggcucgaaagucgcgaguauaccaaacaucugaucaagguggagaauuggauuuuuagaaacccgggguucgcucuugucgccguggcgaucgcauggcuguugggauccucuacgagccagaagguaauauaccucguuaugauccugcugauugcccccgcuuauuccaucagguguauuggcgugucaaaucgggacuuugucgaaggcaugagugggggaacuuggguggaugugguccucgagcacgguggcugcguuaccgugauggcccaggacaaaccuacaguagauaucgaauuagugacuaccacagucagcaacauggcagaggugcgcucuuacuguuacgaggcuuccauaucagacauggccagcgauagucgaugcccaacccaaggggaagcguaucuggacaagcagucugacacgcaguacguuuguaaaagaacucuuguggauaggggauggggcaaugguugcggguuguucggaaagggcucccuggucacaugcgccaaauuuaccuguagcaagaagaugacuggcaaaucgauucagcccgagaaccuagaauaucggaucaugcucucugugcacgggucccaacauucaggaaugauugguuacgagacagacgaagaucgugcaaagguagagguuaccccuaauaguccacgcgcugaggccacgcugggcggguucggaagccuuggccuggacugcgaacccagaaccgguuuggauuuuuccgaccucuauuaccugacaaugaacaauaaacacugguuagugcauaaggagugguuccacgauaucccucugccauggcacgcuggggccgacacuggcaccccgcauuggaacaauaaagaagcacucgucgaguuuaaggaugcccacgcuaaaaggcagacaguggucgugcuuggaucucaggaaggcgcgguucauacugcacuggccggggcuuuggaggccgagauggacggagcaaagggucggcuauucagcggccaccugaagugucgacucaaaauggauaagcugcgccuuaaaggggugucauauagucugugcaccgccgcuuuuacauucaccaagguacccgccgaaacuuugcauggaacggucacaguggagguucaguacgcaggcaccgacgguccuuguaaaaucccagugcaaauggcggucgacaugcagacucucacccccguggggagacugauuacagcuaacccuguaauaaccgaauccacugagaauagcaagaugauguuagaacuggauccacccuuuggcgacucuuacaucgugauuggaguuggcgauaagaaaaucacacaccacuggcauaggucagggaguacgauaggaaaggccuucgaggcaaccguccggggugccaaacgcauggcugugcuaggcgacacugccugggauuucgggagcgugggaggcgucuuuaacucccucgguaaggggauucaccagaucuucggcgcagcuuuuaaaucucuguucggaggcaugucgugguuuagccaaauccuuauugggacauugcugguuuggcucggacugaacaccaagaauggcuccaucucacuuacaugccuggccuuggguggggugaugauuuuccucaguacugcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11455 - RNA, 2458 nt, Artificial Sequence
  ZIKV (strain NatalRGN) prME-short variant mRNA Design 2 opt
ggggcgcugccuacggagguggcagccaucuccuucucggcaucaagcuuaccaugaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacaugugcgaugccacgaugaguuacgaguguccuauguuagacgaaggaguggagccagaugacguagauugcugguguaauaccacaagcacuuggguggucuaugguaccugccaucacaaaaagggcgaagcucgccgaucccguagagcagugacacugccgucucauucgaccaggaaacuacaaacucggucacagacauggcucgagagccgcgaguacaccaagcaccugaucagaguugaaaacuggauuuuuaggaaucccggguucgcccuugcugccgcggcaaucgccuggcuguugggaaguuccacgucucagaaagugauauaucucgucaugauccugcugauugcuccugccuacagcauccgguguauuggcguguccaaccgcgacuuuguagagggcaugucagggggaacuuggguugaugugguccucgaacaugguggcugcgugaccgugauggcacaggacaagccaacagucgauaucgaguuaguuacuaccacagugaguaauauggcugagguacgaagcuacuguuaugaagccucuauauccgacauggcgucagauagcagaugccccacccaaggggaggccuaccuggacaagcagagugacacgcaguauguguguaaaaggacucuugucgaucggggauggggcaacgguugcggguuguucggaaagggcucucuggugacaugcgcaaaauuugcuuguuccaagaaaaugaccggcaagagcauucagccugaaaaucuagaguaccguaucaugcucucgguucacgggucucaacacuccggaaugauugugaacgacacuggucaugaaacagaugagaaucgcgccaaggucgagaucaccccaaacucacccagagcugaagccacgcugggcggguucggaagucuuggccuggacugcgagccuaggaccgguuuggauuuuagcgaccucuauuaccugacaaugaauaacaaacacugguuagugcauaaggaaugguuccacgauaucccacugccguggcacgcaggggccgacacuggcacaccccauuggaauaacaaagaggcucucguagaauuuaaggaugcgcacgcaaaacggcagaccguugugguccuuggaucccaggagggcgccgugcauacugcucuggccggggcauuggaggccgaaauggacggagcuaagggucgacuaucuagcggccaccugaaaugucgccucaagauggauaagcugagacuuaaaggggucucauauagucugugcaccgccgcauucacauuuaccaagauuccugcggagacuuugcauggaacggugacaguugaagugcaguacgcuggcaccgacgguccauguaaaguacccgcccaaauggcagucgacaugcagacucucaccccuguggggaggcugauaacagccaacccaguuaucaccgaguccacugaaaauagcaagaugauguuagagcuggaucccccguucggcgacucuuacauugugaucggagucggcgagaaaaagauaacacaccacuggcaucggucagggaguacgauuggaaaggcuuuugaagccaccgugcgcggugcaaaaagaauggcuguacuaggcgauacugccugggacuucgggagcgugggaggcgcgcucaacucccuggguaaggggauccaccagaucuucggcgccgcuuuuaaaucucuuuucggaggcaugucgugguuuagccaaauuuugaucgggacacugcucauguggcugggacuuaauaccaagaacggcuccauuucacugaugugcuuggcacucggugggguucugauauucuuaaguacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11456 - RNA, 2485 nt, Artificial Sequence
  ZIKV (strain ZikaSPH2015) prME-short variant mRNA Design 2 opt
ggggcgcugccuacggagguggcagccaucuccuucucggcaucaagcuuaccaugggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacaugugcgaugccacgaugaguuacgaguguccuauguuagacgaagggguggagccagaugacguagauugcugguguaacaccacaagcacuuggguggucuauggaaccugccaucacaaaaagggcgaagcucguagauccaggcgggcagugacacugccgucucauucgacccgcaaacuacagacuagaucacagacauggcucgagagcagggaguacaccaagcaccugauccggguugaaaauuggauuuuucgcaaccccggcuucgcccuugcugccgcggcaaucgccuggcuguuggggaguuccacgucucagaaggugauauaucucgucaugauccugcugauugcuccugccuacagcauccgauguauuggaguguccaauagagacuuuguagaggguaugucaggcgggacuuggguugauaucgugcucgaacauggaggcugcgucaccgugauggcacaagacaaaccaacaguggauauagaguuagucacuaccacaguuaguaacauggcugaggugaggagcuacuguuaugaagccucuauuuccgacauggcgucagauagccggugccccacccagggugaggccuaccuggacaagcagagugacacgcaguauguauguaaacguacucuuguggaucgcggguggggaaauggcugcggcuuguucgggaagggaucucuggucacaugcgcaaaauuugcuuguuccaagaagaugaccgguaaaagcauccaaccugaaaaccuagaguacagaauuaugcucucggugcacggcucucagcacuccgggaugaucguuaaugacacuggacaugaaacagaugagaacagggccaagguggagaucaccccaaauucaccccgggcugaagccacgcugggcgguuucgggagucuuggccuggacugcgagccucgaaccggauuggauuuuagcgaccucuauuaccugacaaugaacaauaaacacugguuaguccauaaggaaugguuccacgauauuccacugccguggcacgcaggcgccgacacugggacaccccauuggaacaacaaagaggcucucguggaauuuaaggaugcgcacgcaaaacgccagaccguaguugugcuuggaucccaggagggugccguccauacugcucuggccggcgcauuggaggccgaaauggacggggcuaagggaagacuaucuagcggccaccugaaguguaggcucaaaauggauaagcugcggcuuaaaggugugucauauagucugugcaccgccgcauucacauuuaccaagauaccugcggagacuuugcaugggacggucacaguggaaguucaauacgcuggcaccgacggaccauguaaagugcccgcccagauggcaguagacaugcagacucucaccccugucggccgccugaucacagccaauccagugauuaccgaguccacugaaaacagcaagaugauguuagagcuggaucccccguucggggacucuuacaucguuauaggagugggugagaagaaaauuacacaccacuggcauagaucaggcaguacgcuagggaaggcuuuuagcaccacucucaaaggagcccaaaggcuggcagcucuuggcgauacagccugggacuucgguuccaucgggggcgucuucaauucuaucggacgugcggugcaccagguauuuggcggggccuuccggaccuuguuuggaggcaugucguggauuacacagggucugaugggggcucuccugcuuuggaugggagugaacgcacgagauagaagcaucgcccuggcuuucuuggccacuggcgguguucucgucuuucuggcaaccaaugugcaugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11457 - RNA, 2485 nt, Artificial Sequence
  ZIKV (isolate Z1106033) prME-short variant mRNA Design 2 opt
ggggcgcugccuacggagguggcagccaucuccuucucggcaucaagcuuaccaugggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacacgugcgaugccaccaugaguuacgaguguccuauguuagacgaagggguggagccagaugacguagauugcugguguaacacaacuagcaccuggguggucuauggaacaugccaucacaaaaagggcgaagcucguagauccaggcgggcagugacccugccgucucauucgacucgcaaacuacagacaagaucacagaccuggcucgagagcagggaguacacgaagcaccugauccggguugaaaauuggauuuuucgcaaccccggcuucgcccuugcugccgcggcaaucgccuggcuguuggggaguuccacuucucagaaggugauauaucucgucaugauccugcugauugcuccugccuacagcauccgauguauuggaguguccaauagagacuuuguagaggguaugucaggcgggaccuggguugaugugguccucgaacauggaggcugcgugacagugauggcacaagacaaaccaacugucgauaucgaguuaguuaccacaaccgugaguaacauggcugagguaaggagcuacuguuaugaagccucuauauccgacauggcgucagauagccggugccccacgcagggugaggccuaccuggacaagcagagugacacucaguauguguguaaacguacacuugucgaucgcggguggggaaauggcugcggcuuguucgggaagggaucucuggugaccugcgcaaaauuugcuuguuccaagaagaugacugguaaaagcauucaaccugaaaaccuagaguacagaaucaugcucucgguucacggcucucagcacuccgggaugauugugaaugacacaggacaugaaaccgaugagaacagggccaaggucgagaucacgccaaauucaccccgggcugaagccacccugggcgguuucgggagucuuggccuggacugcgagccucgaacaggauuggauuuuagcgaccucuauuaccugacuaugaacaauaaacacugguuagugcauaaggaaugguuccacgauaucccacugccguggcacgcaggcgccgacaccgggacaccccauuggaacaacaaagaggcucucguagaauuuaaggaugcgcacgcaaaacgccagacuguugugguccuuggaucccaggagggugccgugcauaccgcucuggccggcgcauuggaggccgaaauggacggggcuaagggaagacuaucuagcggccaccugaaguguaggcucaaaauggauaagcugcggcuuaaaggugucucauauagucugugcacagccgcauucaccuuuacuaagauuccugcggagacguugcaugggacagugaccguugaagugcaauacgcuggcacugacggaccauguaaaguacccgcccagauggcagucgacaugcagacccucacaccugugggccgccugauaaccgccaauccaguuaucacugaguccacagaaaacagcaagaugauguuagagcuggaucccccguucggggacucuuacauugugaucggagucggugagaagaaaauaacgcaccacuggcauagaucaggcaguacccuagggaaggcuuuuagcacuacacucaaaggagcccaaaggcuggcagcucuuggcgauaccgccugggacuucgguuccauugggggcguguucaauucuaucggacgugcgguacaccagguguuuggcggggccuuccggacauuguuuggaggcaugucguggaucacucagggucugaugggggcucuccugcuuuggaugggaguuaacgcacgagauagaagcauugcccuggcuuucuuggccaccggcgguguccucguguuucuggcaacgaaugugcaugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11458 - RNA, 2473 nt, Artificial Sequence
  ZIKV (strain MR 766) prME-short variant mRNA Design 2 opt
ggggcgcugccuacggagguggcagccaucuccuucucggcaucaagcuuaccaugggcagaaagcagaacaaaaggggagggaaugaggguagcaucauguggcuggccucccucgcuguggucauugcaugcgccggcgcgauaacccggcgcgggucugcuuacuauauguaccuugaccgaucagaugccggaaaggcaaucaguuucgccacaacucugggcguuaacaaaugucacgugcaaauuauggacuugggucauaugugcgaugcuacgaugagcuaugaaugucccauguuagacgaggggguagaaccugaugacguggauugcugguguaauaccacauccacuugggucguguacggaaccugccaccauaagaaaggcgaggcacguagaucuaggcgggccguuacacugccaucgcacucaacccgcaagcuacagacuagaagccagacauggcucgaaaguagggaguauaccaagcaucugaucaaaguggagaacuggauuuuucggaauccgggcuucgcucuugucgccguggcgaucgcauggcuguugggguccucuacgagccagaagguaauauaccucguuaugauccugcugauugcccccgcuuauuccauccgcuguauuggagugucaaaccgagacuuugucgaagguaugaguggcgggacuuggguggaugugguccucgagcacggaggcugcguuaccgugauggcccaagacaaaccuacaguagauaucgaauuagugacuaccacagucagcaauauggcagaggugagaucuuacuguuacgaggcuuccauaucagacauggccagcgauaguaggugcccaacccagggugaagcguaucuggacaagcagucugacacgcaguacguuuguaaacggacucuuguggaucguggguggggaaacggcugcggcuuguucgggaagggaucccuggucacaugcgccaaguuuaccuguagcaaaaagaugacugguaaaucgauucaacccgagaaucuagaauaucgcaucaugcucucugugcacggcucccagcauucagggaugauuggauacgagacagacgaagauagagcaaagguagagguuaccccuaacaguccaagggcugaggccacgcugggcgguuucgggagccuuggccuggacugcgaaccccggaccggauuggauuuuuccgaccucuauuaccugacaaugaauaacaaacacugguuagugcauaaggagugguuccacgauaucccucugccauggcacgcuggcgccgacacugggaccccgcauuggaauaacaaagaagcacucgucgaguuuaaggaugcccacgcuaagcgacagacaguggucgugcuuggaucucaggaaggugcgguucauacugcacuggccggcgcuuuggaggccgagauggacggggcaaaaggacgccuauucagcggccaccugaaguguagacucaaaauggauaagcugaggcuuaaaggugugucauauagucugugcaccgccgcuuuuacauucaccaagguacccgccgaaacuuugcaugggacggucacaguggagguucaauacgcaggcaccgacggaccuuguaagaucccagugcagauggcggucgacaugcagacucucacccccgugggccggcugauuacagcuaauccuguaauaaccgaauccacugagaacagcaaaaugauguuagaacuggauccacccuuuggggacucuuacaucgugauuggaguuggugauaagaaaaucacacaccacuggcaucgcucaggcaguacgcuagggaaggccuucagcaccacucucaaaggagcacaaagacuggccgcucuuggcgacacagccugggauuucgguuccauagggggcgucuuuaacucuauuggaagggcagugcaccagguguucggcggggcuuuucguaccuuguucggaggcaugucguggaucacacagggucugaugggggcccuccugcuuuggaugggagucaaugcgcgggaccgaagcaucgcccuggcauuuuuggcuacuggcgguguucucguguuccuggccaccaacgugcaugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11459 - RNA, 2485 nt, Artificial Sequence
  ZIKV (strain NatalRGN) prME-short variant mRNA Design 2 opt
ggggcgcugccuacggagguggcagccaucuccuucucggcaucaagcuuaccaugggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacaugugcgaugccacgaugaguuacgaguguccuauguuagacgaagggguggagccagaugacguagauugcugguguaacaccacaagcacuuggguggucuauggaaccugccaucacaaaaagggcgaagcucguagauccaggcgggcagugacacugccgucucauucgacccgcaaacuacagacuagaucacagacauggcucgagagcagggaguacaccaagcaccugauccggguugaaaauuggauuuuucgcaaccccggcuucgcccuugcugccgcggcaaucgccuggcuguuggggaguuccacgucucagaaggugauauaucucgucaugauccugcugauugcuccugccuacagcauccgauguauuggaguguccaauagagacuuuguagaggguaugucaggcgggacuuggguugaugugguccucgaacauggaggcugcgugaccgugauggcacaagacaaaccaacagucgauaucgaguuaguuacuaccacagugaguaacauggcugagguaaggagcuacuguuaugaagccucuauauccgacauggcgucagauagccggugccccacccagggugaggccuaccuggacaagcagagugacacgcaguauguguguaaacguacucuugucgaucgcggguggggaaauggcugcggcuuguucgggaagggaucucuggugacaugcgcaaaauuugcuuguuccaagaagaugaccgguaaaagcauucaaccugaaaaccuagaguacagaaucaugcucucgguucacggcucucagcacuccgggaugauugugaaugacacuggacaugaaacagaugagaacagggccaaggucgagaucaccccaaauucaccccgggcugaagccacgcugggcgguuucgggagucuuggccuggacugcgagccucgaaccggauuggauuuuagcgaccucuauuaccugacaaugaacaauaaacacugguuagugcauaaggaaugguuccacgauaucccacugccguggcacgcaggcgccgacacugggacaccccauuggaacaacaaagaggcucucguagaauuuaaggaugcgcacgcaaaacgccagaccguugugguccuuggaucccaggagggugccgugcauacugcucuggccggcgcauuggaggccgaaauggacggggcuaagggaagacuaucuagcggccaccugaaguguaggcucaaaauggauaagcugcggcuuaaaggugucucauauagucugugcaccgccgcauucacauuuaccaagauuccugcggagacuuugcaugggacggugacaguugaagugcaauacgcuggcaccgacggaccauguaaaguacccgcccagauggcagucgacaugcagacucucaccccugugggccgccugauaacagccaauccaguuaucaccgaguccacugaaaacagcaagaugauguuagagcuggaucccccguucggggacucuuacauugugaucggagucggugagaagaaaauaacacaccacuggcauagaucaggcaguacgcuagggaaggcuuuuagcaccacucucaaaggagcccaaaggcuggcagcucuuggcgauacagccugggacuucgguuccauugggggcguguucaauucuaucggacgugcgguacaccagguguuuggcggggccuuccggaccuuguuuggaggcaugucguggaucacacagggucugaugggggcucuccugcuuuggaugggaguuaacgcacgagauagaagcauugcccuggcuuucuuggccacuggcgguguccucguguuucuggcaaccaaugugcaugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11460 - RNA, 2458 nt, Artificial Sequence
  ZIKV (strain ZikaSPH2015) prME-short variant mRNA Design 2 opt
ggggcgcugccuacggagguggcagccaucuccuucucggcaucaagcuuaccaugaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacaugugcgaugccacgaugaguuacgaguguccuauguuagacgaaggaguggagccagaugacguagauugcugguguaauaccacaagcacuuggguggucuaugguaccugccaucacaaaaagggcgaagcucgccgaucccguagagcagugacacugccgucucauucgaccaggaaacuacaaacucggucacagacauggcucgagagccgcgaguacaccaagcaccugaucagaguugaaaacuggauuuuuaggaaucccggguucgcccuugcugccgcggcaaucgccuggcuguugggaaguuccacgucucagaaagugauauaucucgucaugauccugcugauugcuccugccuacagcauccgguguauuggcguguccaaccgcgacuuuguagagggcaugucagggggaacuuggguugauaucgugcucgaacaugguggcugcgucaccgugauggcacaggacaagccaacaguggauauagaguuagucacuaccacaguuaguaauauggcugaggugcgaagcuacuguuaugaagccucuauuuccgacauggcgucagauagcagaugccccacccaaggggaggccuaccuggacaagcagagugacacgcaguauguauguaaaaggacucuuguggaucggggauggggcaacgguugcggguuguucggaaagggcucucuggucacaugcgcaaaauuugcuuguuccaagaaaaugaccggcaagagcauccagccugaaaaucuagaguaccguauuaugcucucggugcacgggucucaacacuccggaaugaucguuaacgacacuggucaugaaacagaugagaaucgcgccaagguggagaucaccccaaacucacccagagcugaagccacgcugggcggguucggaagucuuggccuggacugcgagccuaggaccgguuuggauuuuagcgaccucuauuaccugacaaugaauaacaaacacugguuaguccauaaggaaugguuccacgauauuccacugccguggcacgcaggggccgacacuggcacaccccauuggaauaacaaagaggcucucguggaauuuaaggaugcgcacgcaaaacggcagaccguaguugugcuuggaucccaggagggcgccguccauacugcucuggccggggcauuggaggccgaaauggacggagcuaagggucgacuaucuagcggccaccugaaaugucgccucaagauggauaagcugagacuuaaaggggugucauauagucugugcaccgccgcauucacauuuaccaagauaccugcggagacuuugcauggaacggucacaguggaaguucaguacgcuggcaccgacgguccauguaaagugcccgcccaaauggcaguagacaugcagacucucaccccugucgggaggcugaucacagccaacccagugauuaccgaguccacugaaaauagcaagaugauguuagagcuggaucccccguucggcgacucuuacaucguuauaggagugggcgagaaaaagauuacacaccacuggcaucggucagggaguacgcuaggaaaggcuuuuagcaccacucucaaaggugcccagcgccuggcagcucuuggcgauacagccugggacuucggguccaucggaggcgucuucaacucuaucgguagagcggugcaccaaguauuugggggcgccuucaggaccuuguuuggaggcaugucguggauuacacaggggcugaugggagcucuccugcuuuggaugggcgugaaugcacgugaucggagcaucgcccuggcuuucuuggccacuggugggguucucgucuuucuggcaaccaacgugcaugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11461 - RNA, 2458 nt, Artificial Sequence
  ZIKV (isolate Z1106033) prME-short variant mRNA Design 2 opt
ggggcgcugccuacggagguggcagccaucuccuucucggcaucaagcuuaccaugaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacacgugcgaugccaccaugaguuacgaguguccuauguuagacgaaggaguggagccagaugacguagauugcugguguaauacaacuagcaccuggguggucuauggcacaugccaucacaaaaagggugaagcucgccgaucccguagagcagugacccugccgucucauucgacuaggaaacuacaaacacggucacagaccuggcucgagagccgcgaguacacgaagcaccugaucagaguugaaaacuggauuuuuaggaaucccggguucgcccuugcugccgcggcaaucgccuggcuguugggaaguuccacuucucagaaagugauauaucucgucaugauccugcugauugcuccugccuacagcauccgguguauuggcguguccaaccgcgacuuuguagagggcaugucagggggaaccuggguugaugugguccucgaacaugguggcugcgugacagugauggcacaggacaagccaacugucgauaucgaguuaguuaccacaaccgugaguaauauggcugagguacgaagcuacuguuaugaagccucuauauccgacauggcgucagauagcagaugccccacgcaaggggaggccuaccuggacaagcagagugacacucaguauguguguaaaaggacacuugucgaucggggauggggcaacgguugcggguuguucggaaagggcucucuggugaccugcgcaaaauuugcuuguuccaagaaaaugacuggcaagagcauucagccugaaaaucuagaguaccguaucaugcucucgguucacgggucucaacacuccggaaugauugugaacgacacaggucaugaaaccgaugagaaucgcgccaaggucgagaucacgccaaacucacccagagcugaagccacccugggcggguucggaagucuuggccuggacugcgagccuaggacagguuuggauuuuagcgaccucuauuaccugacuaugaauaacaaacacugguuagugcauaaggaaugguuccacgauaucccacugccguggcacgcaggggccgacaccggcacaccccauuggaauaacaaagaggcucucguagaauuuaaggaugcgcacgcaaaacggcagacuguugugguccuuggaucccaggagggcgccgugcauaccgcucuggccggggcauuggaggccgaaauggacggagcuaagggucgacuaucuagcggccaccugaaaugucgccucaagauggauaagcugagacuuaaaggggucucauauagucugugcacagccgcauucaccuuuacuaagauuccugcggagacguugcauggaacagugaccguugaagugcaguacgcuggcacugacgguccauguaaaguacccgcccaaauggcagucgacaugcagacccucacaccuguggggaggcugauaaccgccaacccaguuaucacugaguccacagaaaauagcaagaugauguuagagcuggaucccccguucggcgacucuuacauugugaucggagucggcgagaaaaagauaacgcaccacuggcaucggucagggaguacccuaggaaaggcuuuuagcacuacacucaaaggugcccagcgccuggcagcucuuggcgauaccgccugggacuucggguccauuggaggcguguucaacucuaucgguagagcgguacaccaaguguuugggggcgccuucaggacauuguuuggaggcaugucguggaucacucaggggcugaugggagcucuccugcuuuggaugggcguuaaugcacgugaucggagcauugcccuggcuuucuuggccaccggugggguccucguguuucuggcaacgaacgugcaugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11462 - RNA, 2446 nt, Artificial Sequence
  ZIKV (strain MR 766) prME-short variant mRNA Design 2 opt
ggggcgcugccuacggagguggcagccaucuccuucucggcaucaagcuuaccaugaacgagggcagcaucauguggcuggccucccucgcuguggucauugcaugcgccggggcgauaaccagaaggggaucugcuuacuauauguaccuugaccggucagaugccgguaaggcaaucaguuucgccacaacucugggcguuaauaaaugucacgugcagauuauggacuuggggcauaugugcgaugcuacgaugagcuaugaaugucccauguuagacgagggaguagaaccugaugacguggauugcugguguaacaccacauccacuugggucguguacgguaccugccaccauaagaaaggcgaggcacgccgaucucguagagccguuacacugccaucgcacucaaccaggaagcuacaaacucggagccagacauggcucgaaagucgcgaguauaccaaacaucugaucaagguggagaauuggauuuuuagaaacccgggguucgcucuugucgccguggcgaucgcauggcuguugggauccucuacgagccagaagguaauauaccucguuaugauccugcugauugcccccgcuuauuccaucagguguauuggcgugucaaaucgggacuuugucgaaggcaugagugggggaacuuggguggaugugguccucgagcacgguggcugcguuaccgugauggcccaggacaaaccuacaguagauaucgaauuagugacuaccacagucagcaacauggcagaggugcgcucuuacuguuacgaggcuuccauaucagacauggccagcgauagucgaugcccaacccaaggggaagcguaucuggacaagcagucugacacgcaguacguuuguaaaagaacucuuguggauaggggauggggcaaugguugcggguuguucggaaagggcucccuggucacaugcgccaaauuuaccuguagcaagaagaugacuggcaaaucgauucagcccgagaaccuagaauaucggaucaugcucucugugcacgggucccaacauucaggaaugauugguuacgagacagacgaagaucgugcaaagguagagguuaccccuaauaguccacgcgcugaggccacgcugggcggguucggaagccuuggccuggacugcgaacccagaaccgguuuggauuuuuccgaccucuauuaccugacaaugaacaauaaacacugguuagugcauaaggagugguuccacgauaucccucugccauggcacgcuggggccgacacuggcaccccgcauuggaacaauaaagaagcacucgucgaguuuaaggaugcccacgcuaaaaggcagacaguggucgugcuuggaucucaggaaggcgcgguucauacugcacuggccggggcuuuggaggccgagauggacggagcaaagggucggcuauucagcggccaccugaagugucgacucaaaauggauaagcugcgccuuaaaggggugucauauagucugugcaccgccgcuuuuacauucaccaagguacccgccgaaacuuugcauggaacggucacaguggagguucaguacgcaggcaccgacgguccuuguaaaaucccagugcaaauggcggucgacaugcagacucucacccccguggggagacugauuacagcuaacccuguaauaaccgaauccacugagaauagcaagaugauguuagaacuggauccacccuuuggcgacucuuacaucgugauuggaguuggcgauaagaaaaucacacaccacuggcauaggucagggaguacgcuaggaaaggccuucagcaccacucucaaaggugcacagcggcuggccgcucuuggcgacacagccugggauuucggguccauaggaggcgucuuuaacucuauuggucgcgcagugcaccaaguguucgggggcgcuuuuagaaccuuguucggaggcaugucguggaucacacaggggcugaugggagcccuccugcuuuggaugggcgucaacgcgagggaccguagcaucgcccuggcauuuuuggcuacuggugggguucucguguuccuggccaccaaugugcaugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11463 - RNA, 2458 nt, Artificial Sequence
  ZIKV (strain NatalRGN) prME-short variant mRNA Design 2 opt
ggggcgcugccuacggagguggcagccaucuccuucucggcaucaagcuuaccaugaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacaugugcgaugccacgaugaguuacgaguguccuauguuagacgaaggaguggagccagaugacguagauugcugguguaauaccacaagcacuuggguggucuaugguaccugccaucacaaaaagggcgaagcucgccgaucccguagagcagugacacugccgucucauucgaccaggaaacuacaaacucggucacagacauggcucgagagccgcgaguacaccaagcaccugaucagaguugaaaacuggauuuuuaggaaucccggguucgcccuugcugccgcggcaaucgccuggcuguugggaaguuccacgucucagaaagugauauaucucgucaugauccugcugauugcuccugccuacagcauccgguguauuggcguguccaaccgcgacuuuguagagggcaugucagggggaacuuggguugaugugguccucgaacaugguggcugcgugaccgugauggcacaggacaagccaacagucgauaucgaguuaguuacuaccacagugaguaauauggcugagguacgaagcuacuguuaugaagccucuauauccgacauggcgucagauagcagaugccccacccaaggggaggccuaccuggacaagcagagugacacgcaguauguguguaaaaggacucuugucgaucggggauggggcaacgguugcggguuguucggaaagggcucucuggugacaugcgcaaaauuugcuuguuccaagaaaaugaccggcaagagcauucagccugaaaaucuagaguaccguaucaugcucucgguucacgggucucaacacuccggaaugauugugaacgacacuggucaugaaacagaugagaaucgcgccaaggucgagaucaccccaaacucacccagagcugaagccacgcugggcggguucggaagucuuggccuggacugcgagccuaggaccgguuuggauuuuagcgaccucuauuaccugacaaugaauaacaaacacugguuagugcauaaggaaugguuccacgauaucccacugccguggcacgcaggggccgacacuggcacaccccauuggaauaacaaagaggcucucguagaauuuaaggaugcgcacgcaaaacggcagaccguugugguccuuggaucccaggagggcgccgugcauacugcucuggccggggcauuggaggccgaaauggacggagcuaagggucgacuaucuagcggccaccugaaaugucgccucaagauggauaagcugagacuuaaaggggucucauauagucugugcaccgccgcauucacauuuaccaagauuccugcggagacuuugcauggaacggugacaguugaagugcaguacgcuggcaccgacgguccauguaaaguacccgcccaaauggcagucgacaugcagacucucaccccuguggggaggcugauaacagccaacccaguuaucaccgaguccacugaaaauagcaagaugauguuagagcuggaucccccguucggcgacucuuacauugugaucggagucggcgagaaaaagauaacacaccacuggcaucggucagggaguacgcuaggaaaggcuuuuagcaccacucucaaaggugcccagcgccuggcagcucuuggcgauacagccugggacuucggguccauuggaggcguguucaacucuaucgguagagcgguacaccaaguguuugggggcgccuucaggaccuuguuuggaggcaugucguggaucacacaggggcugaugggagcucuccugcuuuggaugggcguuaaugcacgugaucggagcauugcccuggcuuucuuggccacuggugggguccucguguuucuggcaaccaacgugcaugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11464 - RNA, 2485 nt, Artificial Sequence; identical to SEQ ID NO: 11448
  ZIKV (strain ZikaSPH2015) ME variant mRNA Design 2 opt

SEQ ID NO: 11465 - RNA, 2485 nt, Artificial Sequence; identical to SEQ ID NO: 11449
  ZIKV (isolate Z1106033) ME variant mRNA Design 2 opt

SEQ ID NO: 11466 - RNA, 2473 nt, Artificial Sequence; identical to SEQ ID NO: 11450
  ZIKV (strain MR 766) ME variant mRNA Design 2 opt

SEQ ID NO: 11467 - RNA, 2485 nt, Artificial Sequence; identical to SEQ ID NO: 11451
  ZIKV (strain NatalRGN) ME variant mRNA Design 2 opt

SEQ ID NO: 11468 - RNA, 2458 nt, Artificial Sequence; identical to SEQ ID NO: 11452
  ZIKV (strain ZikaSPH2015) ME variant mRNA Design 2 opt

SEQ ID NO: 11469 - RNA, 2458 nt, Artificial Sequence; identical to SEQ ID NO: 11453
  ZIKV (isolate Z1106033) ME variant mRNA Design 2 opt

SEQ ID NO: 11470 - RNA, 2446 nt, Artificial Sequence; identical to SEQ ID NO: 11454
  ZIKV (strain MR 766) ME variant mRNA Design 2 opt

SEQ ID NO: 11471 - RNA, 2458 nt, Artificial Sequence; identical to SEQ ID NO: 11455
  ZIKV (strain NatalRGN) ME variant mRNA Design 2 opt

SEQ ID NO: 11472 - RNA, 2485 nt, Artificial Sequence
  ZIKV (strain ZikaSPH2015) prME-short variant mRNA Design 2 opt
ggggcgcugccuacggagguggcagccaucuccuucucggcaucaagcuuaccaugggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11473 - RNA, 2485 nt, Artificial Sequence
  ZIKV (isolate Z1106033) prME-short variant mRNA Design 2 opt
ggggcgcugccuacggagguggcagccaucuccuucucggcaucaagcuuaccaugggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11474 - RNA, 2473 nt, Artificial Sequence
  ZIKV (strain MR 766) prME-short variant mRNA Design 2 opt
ggggcgcugccuacggagguggcagccaucuccuucucggcaucaagcuuaccaugggcagaaagcagaacaagagaggcggcaacgagggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11475 - RNA, 2485 nt, Artificial Sequence
  ZIKV (strain NatalRGN) prME-short variant mRNA Design 2 opt
ggggcgcugccuacggagguggcagccaucuccuucucggcaucaagcuuaccaugggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11476 - RNA, 2458 nt, Artificial Sequence
  ZIKV (strain ZikaSPH2015) prME-short variant mRNA Design 2 opt
ggggcgcugccuacggagguggcagccaucuccuucucggcaucaagcuuaccaugaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11477 - RNA, 2458 nt, Artificial Sequence
  ZIKV (isolate Z1106033) prME-short variant mRNA Design 2 opt
ggggcgcugccuacggagguggcagccaucuccuucucggcaucaagcuuaccaugaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11478 - RNA, 2446 nt, Artificial Sequence
  ZIKV (strain MR 766) prME-short variant mRNA Design 2 opt
ggggcgcugccuacggagguggcagccaucuccuucucggcaucaagcuuaccaugaacgagggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11479 - RNA, 2458 nt, Artificial Sequence
  ZIKV (strain NatalRGN) prME-short variant mRNA Design 2 opt
ggggcgcugccuacggagguggcagccaucuccuucucggcaucaagcuuaccaugaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11480 - RNA, 2485 nt, Artificial Sequence
  ZIKV (strain ZikaSPH2015) prME-short variant mRNA Design 2 opt
ggggcgcugccuacggagguggcagccaucuccuucucggcaucaagcuuaccaugggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11481 - RNA, 2485 nt, Artificial Sequence
  ZIKV (isolate Z1106033) prME-short variant mRNA Design 2 opt
ggggcgcugccuacggagguggcagccaucuccuucucggcaucaagcuuaccaugggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11482 - RNA, 2473 nt, Artificial Sequence
  ZIKV (strain MR 766) prME-short variant mRNA Design 2 opt
ggggcgcugccuacggagguggcagccaucuccuucucggcaucaagcuuaccaugggcagaaagcagaacaagagaggcggcaacgagggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11483 - RNA, 2485 nt, Artificial Sequence
  ZIKV (strain NatalRGN) prME-short variant mRNA Design 2 opt
ggggcgcugccuacggagguggcagccaucuccuucucggcaucaagcuuaccaugggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11484 - RNA, 2458 nt, Artificial Sequence
  ZIKV (strain ZikaSPH2015) prME-short variant mRNA Design 2 opt
ggggcgcugccuacggagguggcagccaucuccuucucggcaucaagcuuaccaugaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11485 - RNA, 2458 nt, Artificial Sequence
  ZIKV (isolate Z1106033) prME-short variant mRNA Design 2 opt
ggggcgcugccuacggagguggcagccaucuccuucucggcaucaagcuuaccaugaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11486 - RNA, 2446 nt, Artificial Sequence
  ZIKV (strain MR 766) prME-short variant mRNA Design 2 opt
ggggcgcugccuacggagguggcagccaucuccuucucggcaucaagcuuaccaugaacgagggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11487 - RNA, 2458 nt, Artificial Sequence
  ZIKV (strain NatalRGN) prME-short variant mRNA Design 2 opt
ggggcgcugccuacggagguggcagccaucuccuucucggcaucaagcuuaccaugaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11488 - RNA, 2485 nt, Artificial Sequence; identical to SEQ ID NO: 11472
  ZIKV (strain ZikaSPH2015) ME variant mRNA Design 2 opt

SEQ ID NO: 11489 - RNA, 2485 nt, Artificial Sequence; identical to SEQ ID NO: 11473
  ZIKV (isolate Z1106033) ME variant mRNA Design 2 opt

SEQ ID NO: 11490 - RNA, 2473 nt, Artificial Sequence; identical to SEQ ID NO: 11474
  ZIKV (strain MR 766) ME variant mRNA Design 2 opt

SEQ ID NO: 11491 - RNA, 2485 nt, Artificial Sequence; identical to SEQ ID NO: 11475
  ZIKV (strain NatalRGN) ME variant mRNA Design 2 opt

SEQ ID NO: 11492 - RNA, 2458 nt, Artificial Sequence; identical to SEQ ID NO: 11476
  ZIKV (strain ZikaSPH2015) ME variant mRNA Design 2 opt

SEQ ID NO: 11493 - RNA, 2458 nt, Artificial Sequence; identical to SEQ ID NO: 11477
  ZIKV (isolate Z1106033) ME variant mRNA Design 2 opt

SEQ ID NO: 11494 - RNA, 2446 nt, Artificial Sequence; identical to SEQ ID NO: 11478
  ZIKV (strain MR 766) ME variant mRNA Design 2 opt

SEQ ID NO: 11495 - RNA, 2458 nt, Artificial Sequence; identical to SEQ ID NO: 11479
  ZIKV (strain NatalRGN) ME variant mRNA Design 2 opt

SEQ ID NO: 11496 - RNA, 2485 nt, Artificial Sequence
  ZIKV (strain ZikaSPH2015) prME-short variant mRNA Design 2 opt
ggggcgcugccuacggagguggcagccaucuccuucucggcaucaagcuuaccaugggcagaaagcagaacaaacggggcggaaaugagggcagcaucauguggcuggccucccucgcuguggucauugccugcgcgggggcuguuacccgcagaggaucugccuacuauauguaccuggaccggaacgaugccggcgaagcuaucagcuuccccacaacgcuugggaugaauaaguguuauauucaaaucauggaccugggacacaugugcgaugccaccauguccuacgaguguccuaugcucgacgaaggcguggagccggaugacguggauugcugguguaacacaaccucuacaugggucguguaugggaccugccaucacaaaaagggggaagcucgcagaagccggcgcgccguuacacugcccucccauucuaccagaaaacuucagacgcggagccagaccuggcuggagucccgcgaguacacaaagcaccucauuagaguggaaaauuggaucuuucggaacccuggauucgcgcuggccgcugccgcuaucgccuggcugcucggcagcucuaccucccagaaggucauuuaucuggugaugauccuucugauugcgcccgccuacagcauccgcuguauugggguuucuaauagagacuuuguggagggaauguccggcgggacaugggucgauaucgugcucgaacauggaggcugcgugaccgucauggcucaagacaaaccuacgguugauauugagcuggugacaaccacagugagcaacauggccgagguccggucuuacuguuaugaggcuuccaucagcgacauggccuccgauucucgcugccccacccagggcgaagccuaccuugacaagcagagcgacacccaguauguguguaaaagaacacugguugaucggggguggggaaauggcugcgggcuguucggaaagggcucccuggugacgugcgcuaaauuugcguguagcaagaagaugaccgggaaaucuauccaaccugaaaaccuggaguacagaauuaugcucuccguccacggaagccagcacucuggcaugaucgugaaugacacaggccaugaaaccgaugagaaccgcgccaagguugagauuacaccgaauagcccccgggcugaagccacccucgggggauucggcucccuugggcuggacugcgagccuagaacgggacucgauuuuucugaccuguauuaccuuacaaugaacaauaaacacuggcuggugcauaaggaaugguuccacgauaucccccucccuuggcacgccggcgcugacaccgggacaccccauuggaacaacaaagaggcccuggucgaauuuaaggaugcgcacgcuaaacgccagaccguggucgugcugggcagccaggagggagccguucauaccgcccucgcuggcgcccuggaggcugaaauggacggggccaagggacggcuuuccagcggccaccugaaguguagacucaaaauggauaagcugcgccuuaaaggggugucuuauucccugugcacagcggccuucacguuuaccaagauuccggcugagacacuccauggaaccgucacaguggaaguucaauacgccggcaccgacgggccuuguaaagugcccgcucagauggccgucgacaugcagacgcugaccccugugggccggcugaucacagcgaaucccgugaucaccgagagcacagaaaacucuaagaugaugcucgagcuggaucccccuuucggagacuccuacauuguuaucggcgucggggagaagaaaauuacccaccacuggcauagaagcggauccacgaucggcaaggccuuugaagcuacagugcgcggggccaaacggauggcugugcuuggagauaccgccugggacuucggcucugucgggggcgcccugaauagccucggaaagggcauucaccaaaucuucggggcugcguuuaaaucccuguucggaggcaugucuugguuuagccagauccugauugggacacuucucauguggcugggacugaacaccaagaauggcuccaucagccucaugugccuggcccuugggggcgugcugauuuuccucucuaccgcuguuuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11497 - RNA, 2485 nt, Artificial Sequence
  ZIKV (isolate Z1106033) prME-short variant mRNA Design 2 opt
ggggcgcugccuacggagguggcagccaucuccuucucggcaucaagcuuaccaugggcagaaagcagaacaaacgcgggggaaaugagggcagcaucauguggcuggccucccucgcuguggucauugccugcgcgggggcuguuacccggagaggaucugccuacuauauguaccuggaccggaacgaugccggcgaagcuaucagcuuccccacaacgcuugggaugaauaaguguuauauucaaaucauggaccugggacauaccugcgaugccacaauguccuacgaguguccuaugcucgacgaaggcguggagccggaugacguggauugcugguguaacaccacaucuaccugggucguguauggcacaugccaccacaaaaagggggaagcucgcagaagccggcgcgccguuacccugcccucccauucuacgagaaaacuucagacccggagccagacauggcuggagucccgcgaguacaccaagcaccucauuagaguggaaaauuggaucuuucggaacccuggauucgcgcuggccgcugccgcuaucgccuggcugcucggcagcucuacaucccagaaggucauuuaucuggugaugauccuucugauugcgcccgccuacagcauccgcuguauugggguuucuaauagagacuuuguggagggaauguccggcgggaccugggucgauguggugcucgaacauggaggcugcgucacgguuauggcucaagacaaaccuacaguggauaucgagcuggugaccacaaccgucagcaacauggccgaggugcggucuuacuguuaugaggcuuccauuagcgacauggccuccgauucucgcugccccacccagggcgaagccuaccuugacaagcagagcgacacacaguauguuuguaaaagaacgcugguggaucggggguggggaaauggcugcgggcuguucggaaagggcucccuggugaccugcgcuaaauuugcguguagcaagaagaugacagggaaaucuauccaaccugaaaaccuggaguacagaaucaugcucuccgugcacggaagccagcacucuggcaugauuguuaaugacaccggccaugaaacagaugagaaccgcgccaagguggagaucaccccgaauagcccccgggcugaagccacgcucgggggauucggcucccuugggcuggacugcgagccuagaacaggacucgauuuuucugaccuguauuaccuuaccaugaacaauaaacacuggcugguccauaaggaaugguuccacgauauuccccucccuuggcacgccggcgcugacaccgggacaccccauuggaacaacaaagaggcccugguggaauuuaaggaugcgcacgcuaaacgccagaccgucgugguucugggcagccaggagggagccgugcauacagcccucgcuggcgcccuggaggcugaaauggacggggccaagggacggcuuuccagcggccaccugaaguguagacucaaaauggauaagcugcgccuuaaaggggucucuuauucccugugcacggcggccuucaccuuuacaaagaucccggcugagacccuccauggaacagugaccguugaagugcaauacgccggcacggacgggccuuguaaaguccccgcucagauggccguggacaugcagacccugacaccugugggccggcugauuaccgcgaaucccguuaucacagagagcaccgaaaacucuaagaugaugcucgagcuggaucccccuuucggagacuccuacaucgucauuggcgugggggagaagaaaaucacgcaccacuggcauagaagcggauccacaauuggcaaggccuuugaagcuaccgugcgcggggccaaacggauggcuguccuuggagauacagccugggacuucggcucugucgggggcgcccugaauagccucggaaagggcauccaccaaauuuucggggcugcguuuaaaucccuguucggaggcaugucuugguuuagccagauccugaucgggacccuucucauguggcugggacugaacgccaagaauggcuccauuagccucaugugccuggcucuugggggcguucugaucuuccucucuaccgccguguccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11498 - RNA, 2473 nt, Artificial Sequence
  ZIKV (strain MR 766) prME-short variant mRNA Design 2 opt
ggggcgcugccuacggagguggcagccaucuccuucucggcaucaagcuuaccaugggcagaaagcagaacaaacggggcggaaaugagggcagcaucauguggcuggccucccucgcuguggucauugccugcgcgggggcuaucacccgcagaggaucugccuacuauauguaccuggaccggagcgaugccggcaaggcuauuuccuucgccacaacgcuugggguuaacaaaugucacgugcaaaucauggaccugggacauaugugcgaugcuaccaugucuuaugaaugucccaugcucgacgagggcguggaacccgaugacgucgauugcugguguaauacaaccagcacaugggugguuuacgggaccugccaccauaagaaaggggaggcccgcagaucccggcgcgcggugacacugccgucucacagcaccagaaagcugcagacgcggucccagaccuggcuggaaagccgcgaguauacaaagcaucucauuaaagucgagaacuggaucuuuagaaaucccggauucgcccugguggcuguugccaucgcuuggcugcucgggucuuccaccagccagaaggugauuuaccuggucaugauccuucugauugccccugcguauucuauccgguguauugggguguccaaccgcgacuuuguggaaggaaugagcggcgggacaugggucgauguugugcucgagcacggaggcugcgugaccgucauggcccaagacaaacccacgguggauaucgaacugguuacaaccacagugucuaauauggcugaggucagauccuacuguuacgaggccagcauuuccgacauggcuucugauagccggugcccuacccagggcgaagccuaucuugacaagcaguccgacacccaguacguguguaaacgcacacugguugauagaggguggggaaacggcugcggccucuucggaaagggcagccuggugacgugcgccaaguuuaccuguucuaaaaagaugacagggaaauccauccaacccgagaaucuggaauaucggaucaugcucagcguccacggaucucagcauagcggcaugauuggcuacgagaccgacgaagauagagcuaagguggaggucacaccuaacuccccgcgcgcggaggccacccuugggggauucggcucucuugggcuggacugcgaaccccggacgggacucgauuuuagcgaccuguauuaccuuacaaugaauaacaaacacuggcuggugcauaaggagugguuccacgauaucccucuccccuggcacgcuggcgccgacaccgggaccccucauuggaauaacaaagaagcccugguugaguuuaaggaugcucacgccaagagacagacaguggucgugcugggcucccaggaaggagcgguucauaccgcucucgccggcgcccuggaggcugagauggacggggccaaaggacgccuuuucagcggccaccugaagugucggcucaaaauggauaagcugagacuuaaaggggugucuuauucccugugcacagcugccuuuacguucaccaagguccccgcggaaacacuccauggaaccgugacaguggagguucaauacgccggcaccgacgggccguguaagauuccuguccagauggcuguggacaugcagacgcugacccccgugggccgccugaucacagccaauccugucauuaccgaaagcacagagaacucuaaaaugaugcucgaacuggauccucccuuuggagacuccuacaucgugaucggcguuggggauaagaaaauuacccaccacuggcaucggagcggauccacgaucggcaaggcuuucgaggccacagugagaggggcgaaacgcauggccguccuuggagacaccgcuugggauuucggcucuguugggggcguguuuaacagccugggaaagggcauucaccaaaucuucggggccgcuuuuaagucccucuucggaggcaugucuugguuuagccagauucugaucgggacacugcuuguguggcucggacugaauaccaaaaacggcuccaucagccugaccugccucgcccuugggggcgucaugauuuuccugucuacagccguguccgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11499 - RNA, 2485 nt, Artificial Sequence
  ZIKV (strain NatalRGN) prME-short variant mRNA Design 2 opt
ggggcgcugccuacggagguggcagccaucuccuucucggcaucaagcuuaccaugggcagaaagcagaacaaacggggcggaaaugagggcagcaucauguggcuggccucccucgcuguggucauugccugcgcgggggcuguuacccgcagaggaucugccuacuauauguaccuggaccggaacgaugccggcgaagcuaucagcuuccccacaacgcuugggaugaauaaguguuauauucaaaucauggaccugggacacaugugcgaugccaccauguccuacgaguguccuaugcucgacgaaggcguggagccggaugacguggauugcugguguaacacaaccucuacaugggucguguaugggaccugccaucacaaaaagggggaagcucgcagaagccggcgcgccguuacacugcccucccauucuaccagaaaacuucagacgcggagccagaccuggcuggagucccgcgaguacacaaagcaccucauuagaguggaaaauuggaucuuucggaacccuggauucgcgcuggccgcugccgcuaucgccuggcugcucggcagcucuaccucccagaaggucauuuaucuggugaugauccuucugauugcgcccgccuacagcauccgcuguauugggguuucuaauagagacuuuguggagggaauguccggcgggacaugggucgauguggugcucgaacauggaggcugcgucaccguuauggcucaagacaaaccuacgguggauaucgagcuggugacaaccacagucagcaacauggccgaggugcggucuuacuguuaugaggcuuccauuagcgacauggccuccgauucucgcugccccacccagggcgaagccuaccuugacaagcagagcgacacccaguauguuuguaaaagaacacugguggaucggggguggggaaauggcugcgggcuguucggaaagggcucccuggucacgugcgcuaaauuugcguguagcaagaagaugaccgggaaaucuauccaaccugaaaaccuggaguacagaaucaugcucuccgugcacggaagccagcacucuggcaugauuguuaaugacacaggccaugaaaccgaugagaaccgcgccaagguggagaucacaccgaauagcccccgggcugaagccacccucgggggauucggcucccuugggcuggacugcgagccuagaacgggacucgauuuuucugaccuguauuaccuuacaaugaacaauaaacacuggcugguccauaaggaaugguuccacgauauuccccucccuuggcacgccggcgcugacaccgggacaccccauuggaacaacaaagaggcccugguggaauuuaaggaugcgcacgcuaaacgccagaccgucgugguucugggcagccaggagggagccgugcauaccgcccucgcuggcgcccuggaggcugaaauggacggggccaagggacggcuuuccagcggccaccugaaguguagacucaaaauggauaagcugcgccuuaaaggggucucuuauucccugugcacagcggccuucacguuuaccaagaucccggcugagacacuccauggaaccgugacaguugaagugcaauacgccggcaccgacgggccuuguaaaguccccgcucagauggccguggacaugcagacgcugaccccugugggccggcugauuacagcgaaucccguuaucaccgagagcacagaaaacucuaagaugaugcucgagcuggaucccccuuucggagacuccuacaucgucauuggcgugggggagaagaaaaucacccaccacuggcauagaagcggauccacgauuggcaaggccuuugaagcuacagugcgcggggccaaacggauggcuguccuuggagauaccgccugggacuucggcucuguugggggcgcccugaauagccucggaaagggcauccaccaaauuuucggggcugcguuuaaaucccuguucggaggcaugucuugguuuagccagauccugaucgggacacuucucauguggcugggacugaacaccaagaauggcuccauuagccucaugugccuggcccuugggggcgugcugaucuuccucucuaccgcuguguccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11500 - RNA, 2458 nt, Artificial Sequence
  ZIKV (strain ZikaSPH2015) prME-short variant mRNA Design 2 opt
ggggcgcugccuacggagguggcagccaucuccuucucggcaucaagcuuaccaugaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacacaugugcgaugccaccauguccuacgaguguccuaugcucgacgaaggcguggagccggaugacguggauugcugguguaauacaaccucuacaugggucguguaugggaccugccaucacaaaaagggagaagcuagacggagccgcagagccguuacacugcccucccauucuacccggaaacuucaaacgcgcagccagaccuggcuggaguccagagaguacacaaagcaccucauucggguggaaaacuggaucuuucgcaauccuggcuucgcgcuggccgcugccgcuaucgccuggcugcucggcagcucuaccucccagaaagucauuuaucuggugaugauccuucugauugcgcccgccuacagcaucagauguauugggguuucuaaccgggacuuuguggagggaauguccggcgggacaugggucgauaucgugcucgaacauggaggcugcgugaccgucauggcucaggacaagccuacgguugauauugagcuggugacaaccacagugagcaauauggccgagguccgcucuuacuguuaugaggcuuccaucagcgacauggccuccgauucuagaugccccacccaaggggaagccuaccuugacaagcagagcgacacccaguauguguguaaacggacacugguugaucgcggauggggcaacggcugcggacucuucgggaagggcucccuggugacgugcgcuaaauuugcguguagcaagaaaaugaccgggaagucuauccagccugaaaaucuggaguacagaauuaugcucuccguccacggaagccaacacucuggcaugaucgugaacgacacagggcaugaaaccgaugagaaucgggccaagguugagauuacaccgaacagccccagagcugaagccacccugggaggcuucggcucccuugggcuggacugcgagccucgcacgggacucgauuuuucugaccuguauuaccuuacaaugaauaacaaacacuggcuggugcauaaggaaugguuccacgauaucccccucccuuggcacgccggcgcugacaccgggacaccccauuggaauaacaaagaggcccuggucgaauuuaaggaugcgcacgcuaaacggcagaccguggucgugcugggaagccaggagggcgccguucauaccgcccucgcuggggcccuggaggcugaaauggacggcgccaagggaagacuuuccagcggccaccugaaaugucgccucaagauggauaagcugcggcuuaaaggggugucuuauucccugugcacagcggccuucacguuuaccaagauuccggcugagacacuccauggaaccgucacaguggaaguucaguacgccggcaccgacgggccuuguaaagugcccgcucaaauggccgucgacaugcagacgcugaccccugugggaagacugaucacagcgaaccccgugaucaccgagagcacagaaaauucuaagaugaugcucgagcuggaucccccuuucggcgacuccuacauuguuaucggggucggcgagaaaaagauuacccaccacuggcaucgcagcggauccacgaucggcaaggccuuugaagcuacagugagaggggccaaacggauggcugugcuuggagauaccgccugggacuucggcucugucgggggagcccugaacagccucggcaaggggauucaccagaucuucggcgcugcguuuaaaucccuguucggaggcaugucuugguuuagccaaauccugauugggacacuucucauguggcugggacugaauaccaagaacggcuccaucagccucaugugccuggcccuugggggagugcugauuuuccucucuaccgcuguuuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11501 - RNA, 2458 nt, Artificial Sequence
  ZIKV (isolate Z1106033) prME-short variant mRNA Design 2 opt
ggggcgcugccuacggagguggcagccaucuccuucucggcaucaagcuuaccaugaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacauaccugcgaugccacaauguccuacgaguguccuaugcucgacgaaggcguggagccggaugacguggauugcugguguaauaccacaucuaccugggucguguaugggacaugccaccacaaaaagggagaagcuagacggagccgcagagccguuacccugcccucccauucuacgcggaaacuucaaacccgcagccagacauggcuggaguccagagaguacaccaagcaccucauucggguggaaaacuggaucuuucgcaauccuggcuucgcgcuggccgcugccgcuaucgccuggcugcucggcagcucuacaucccagaaagucauuuaucuggugaugauccuucugauugcgcccgccuacagcaucagauguauugggguuucuaaccgggacuuuguggagggaauguccggcgggaccugggucgauguggugcucgaacauggaggcugcgucacgguuauggcucaggacaagccuacaguggauaucgagcuggugaccacaaccgucagcaauauggccgaggugcgcucuuacuguuaugaggcuuccauuagcgacauggccuccgauucuagaugccccacccaaggggaagccuaccuugacaagcagagcgacacacaguauguuuguaaacggacgcugguggaucgcggauggggcaacggcugcggacucuucgggaagggcucccuggugaccugcgcuaaauuugcguguagcaagaaaaugacagggaagucuauccagccugaaaaucuggaguacagaaucaugcucuccgugcacggaagccaacacucuggcaugauuguuaacgacaccgggcaugaaacagaugagaaucgggccaagguggagaucaccccgaacagccccagagcugaagccacgcugggaggcuucggcucccuugggcuggacugcgagccucgcacaggacucgauuuuucugaccuguauuaccuuaccaugaauaacaaacacuggcugguccauaaggaaugguuccacgauauuccccucccuuggcacgccggcgcugacaccgggacaccccauuggaauaacaaagaggcccugguggaauuuaaggaugcgcacgcuaaacggcagaccgucgugguucugggaagccaggagggcgccgugcauacagcccucgcuggggcccuggaggcugaaauggacggcgccaagggaagacuuuccagcggccaccugaaaugucgccucaagauggauaagcugcggcuuaaaggggucucuuauucccugugcacggcggccuucaccuuuacaaagaucccggcugagacccuccauggaacagugaccguugaagugcaguacgccggcacggacgggccuuguaaaguccccgcucaaauggccguggacaugcagacccugacaccugugggaagacugauuaccgcgaaccccguuaucacagagagcaccgaaaauucuaagaugaugcucgagcuggaucccccuuucggcgacuccuacaucgucauuggggugggcgagaaaaagaucacgcaccacuggcaucgcagcggauccacaauuggcaaggccuuugaagcuaccgugagaggggccaaacggauggcuguccuuggagauacagccugggacuucggcucugucgggggagcccugaacagccucggcaaggggauccaccagauuuucggcgcugcguuuaaaucccuguucggaggcaugucuugguuuagccaaauccugaucgggacccuucucauguggcugggacugaaugccaagaacggcuccauuagccucaugugccuggcucuugggggaguucugaucuuccucucuaccgccguguccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11502 - RNA, 2446 nt, Artificial Sequence
  ZIKV (strain MR 766) prME-short variant mRNA Design 2 opt
ggggcgcugccuacggagguggcagccaucuccuucucggcaucaagcuuaccaugaacgagggcagcaucauguggcuggccucccucgcuguggucauugccugcgcgggggcuaucaccagacggggaucugccuacuauauguaccuggaccgcagcgaugccggcaaggcuauuuccuucgccacaacgcuugggguuaauaaaugucacgugcagaucauggaccugggacauaugugcgaugcuaccaugucuuaugaaugucccaugcucgacgagggcguggaacccgaugacgucgauugcugguguaacacaaccagcacaugggugguuuacgggaccugccaccauaagaaaggagaggccagacggucccgcagagcggugacacugccgucucacagcacccggaagcugcaaacgcgcucccagaccuggcuggaaagcagagaguauacaaaacaucucauuaaggucgagaauuggaucuuucggaaccccggcuucgcccugguggcuguugccaucgcuuggcugcucgggucuuccaccagccagaaggugauuuaccuggucaugauccuucugauugccccugcguauucuauccgcuguauugggguguccaauagagacuuuguggaaggaaugagcggcgggacaugggucgauguugugcucgagcacggaggcugcgugaccgucauggcccaggacaaacccacgguggauaucgaacugguuacaaccacagugucuaacauggcugagguccgguccuacuguuacgaggccagcauuuccgacauggcuucugauagccgcugcccuacccaaggggaagccuaucuugacaagcaguccgacacccaguacguguguaaaagaacacugguugaucggggauggggcaauggcugcggccucuucggaaagggcagccuggugacgugcgccaaauuuaccuguucuaagaagaugacagggaaauccauccagcccgagaaccuggaauaucgcaucaugcucagcguccacggaucucaacauagcggcaugauuggguacgagaccgacgaagauagagcuaagguggaggucacaccuaauuccccgcgggcggaggccacccugggaggcuucggcucucuugggcuggacugcgaacccagaacgggacucgauuuuagcgaccuguauuaccuuacaaugaacaauaaacacuggcuggugcauaaggagugguuccacgauaucccucuccccuggcacgcuggcgccgacaccgggaccccucauuggaacaauaaagaagcccugguugaguuuaaggaugcucacgccaaacgccagacaguggucgugcugggaucccaggaaggcgcgguucauaccgcucucgccggggcccuggaggcugagauggacggcgccaagggacggcuuuucagcggccaccugaaguguagacucaaaauggauaagcugcgccuuaaaggggugucuuauucccugugcacagcugccuuuacguucaccaagguccccgcggaaacacuccauggaaccgugacaguggagguucaguacgccggcaccgacgggccguguaaaauuccuguccaaauggcuguggacaugcagacgcugacccccgugggacggcugaucacagccaacccugucauuaccgaaagcacagaaaauucuaagaugaugcucgagcuggauccucccuuuggcgacuccuacaucgugaucgggguuggcgauaagaaaauuacccaccacuggcauagaagcggauccacgaucggcaaggcuuucgaggccacagugcgcggggcgaaacggauggccguccuuggagacaccgcuugggauuucggcucuguugggggaguguuuaacagccugggcaaggggauucaccagaucuucggcgccgcuuuuaaaucccucuucggaggcaugucuugguuuagccaaauucugaucgggacacugcuuguguggcucggacugaacaccaagaauggcuccaucagccugaccugccucgcccuugggggagucaugauuuuccuuucuacagccguguccgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11503 - RNA, 2458 nt, Artificial Sequence
  ZIKV (strain NatalRGN) prME-short variant mRNA Design 2 opt
ggggcgcugccuacggagguggcagccaucuccuucucggcaucaagcuuaccaugaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacacaugugcgaugccaccauguccuacgaguguccuaugcucgacgaaggcguggagccggaugacguggauugcugguguaauacaaccucuacaugggucguguaugggaccugccaucacaaaaagggagaagcuagacggagccgcagagccguuacacugcccucccauucuacccggaaacuucaaacgcgcagccagaccuggcuggaguccagagaguacacaaagcaccucauucggguggaaaacuggaucuuucgcaauccuggcuucgcgcuggccgcugccgcuaucgccuggcugcucggcagcucuaccucccagaaagucauuuaucuggugaugauccuucugauugcgcccgccuacagcaucagauguauugggguuucuaaccgggacuuuguggagggaauguccggcgggacaugggucgauguggugcucgaacauggaggcugcgucaccguuauggcucaggacaagccuacgguggauaucgagcuggugacaaccacagucagcaauauggccgaggugcgcucuuacuguuaugaggcuuccauuagcgacauggccuccgauucuagaugccccacccaaggggaagccuaccuugacaagcagagcgacacccaguauguuuguaaacggacacugguggaucgcggauggggcaacggcugcggacucuucgggaagggcucccuggucacgugcgcuaaauuugcguguagcaagaaaaugaccgggaagucuauccagccugaaaaucuggaguacagaaucaugcucuccgugcacggaagccaacacucuggcaugauuguuaacgacacagggcaugaaaccgaugagaaucgggccaagguggagaucacaccgaacagccccagagcugaagccacccugggaggcuucggcucccuugggcuggacugcgagccucgcacgggacucgauuuuucugaccuguauuaccuuacaaugaauaacaaacacuggcugguccauaaggaaugguuccacgauauuccccucccuuggcacgccggcgcugacaccgggacaccccauuggaauaacaaagaggcccugguggaauuuaaggaugcgcacgcuaaacggcagaccgucgugguucugggaagccaggagggcgccgugcauaccgcccucgcuggggcccuggaggcugaaauggacggcgccaagggaagacuuuccagcggccaccugaaaugucgccucaagauggauaagcugcggcuuaaaggggucucuuauucccugugcacagcggccuucacguuuaccaagaucccggcugagacacuccauggaaccgugacaguugaagugcaguacgccggcaccgacgggccuuguaaaguccccgcucaaauggccguggacaugcagacgcugaccccugugggaagacugauuacagcgaaccccguuaucaccgagagcacagaaaauucuaagaugaugcucgagcuggaucccccuuucggcgacuccuacaucgucauuggggugggcgagaaaaagaucacccaccacuggcaucgcagcggauccacgauuggcaaggccuuugaagcuacagugagaggggccaaacggauggcuguccuuggagauaccgccugggacuucggcucuguugggggagcccugaacagccucggcaaggggauccaccagauuuucggcgcugcguuuaaaucccuguucggaggcaugucuugguuuagccaaauccugaucgggacacuucucauguggcugggacugaauaccaagaacggcuccauuagccucaugugccuggcccuugggggagugcugaucuuccucucuaccgcuguguccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11504 - RNA, 2485 nt, Artificial Sequence
  ZIKV (strain ZikaSPH2015) prME-short variant mRNA Design 2 opt
ggggcgcugccuacggagguggcagccaucuccuucucggcaucaagcuuaccaugggcagaaagcagaacaaacggggcggaaaugagggcagcaucauguggcuggccucccucgcuguggucauugccugcgcgggggcuguuacccgcagaggaucugccuacuauauguaccuggaccggaacgaugccggcgaagcuaucagcuuccccacaacgcuugggaugaauaaguguuauauucaaaucauggaccugggacacaugugcgaugccaccauguccuacgaguguccuaugcucgacgaaggcguggagccggaugacguggauugcugguguaacacaaccucuacaugggucguguaugggaccugccaucacaaaaagggggaagcucgcagaagccggcgcgccguuacacugcccucccauucuaccagaaaacuucagacgcggagccagaccuggcuggagucccgcgaguacacaaagcaccucauuagaguggaaaauuggaucuuucggaacccuggauucgcgcuggccgcugccgcuaucgccuggcugcucggcagcucuaccucccagaaggucauuuaucuggugaugauccuucugauugcgcccgccuacagcauccgcuguauugggguuucuaauagagacuuuguggagggaauguccggcgggacaugggucgauaucgugcucgaacauggaggcugcgugaccgucauggcucaagacaaaccuacgguugauauugagcuggugacaaccacagugagcaacauggccgagguccggucuuacuguuaugaggcuuccaucagcgacauggccuccgauucucgcugccccacccagggcgaagccuaccuugacaagcagagcgacacccaguauguguguaaaagaacacugguugaucggggguggggaaauggcugcgggcuguucggaaagggcucccuggugacgugcgcuaaauuugcguguagcaagaagaugaccgggaaaucuauccaaccugaaaaccuggaguacagaauuaugcucuccguccacggaagccagcacucuggcaugaucgugaaugacacaggccaugaaaccgaugagaaccgcgccaagguugagauuacaccgaauagcccccgggcugaagccacccucgggggauucggcucccuugggcuggacugcgagccuagaacgggacucgauuuuucugaccuguauuaccuuacaaugaacaauaaacacuggcuggugcauaaggaaugguuccacgauaucccccucccuuggcacgccggcgcugacaccgggacaccccauuggaacaacaaagaggcccuggucgaauuuaaggaugcgcacgcuaaacgccagaccguggucgugcugggcagccaggagggagccguucauaccgcccucgcuggcgcccuggaggcugaaauggacggggccaagggacggcuuuccagcggccaccugaaguguagacucaaaauggauaagcugcgccuuaaaggggugucuuauucccugugcacagcggccuucacguuuaccaagauuccggcugagacacuccauggaaccgucacaguggaaguucaauacgccggcaccgacgggccuuguaaagugcccgcucagauggccgucgacaugcagacgcugaccccugugggccggcugaucacagcgaaucccgugaucaccgagagcacagaaaacucuaagaugaugcucgagcuggaucccccuuucggagacuccuacauuguuaucggcgucggggagaagaaaauuacccaccacuggcauagaagcggauccacgcuuggcaaggccuuuucuacaacccugaaaggggcucaacgccucgccgcucugggagauacagccugggacuucggcagcaucgggggcguguucaauuccauuggacgggccgugcaccaggucuuuggcggggcuuucagaacccuguuuggaggcaugucuuggaucacccaggggcuuaugggagcgcuccugcuguggaugggcgugaacgcccgcgaucggagcaucgcucucgccuuccuggccacagggggcguucuuguguuucuggcuacgaauguccaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11505 - RNA, 2485 nt, Artificial Sequence
  ZIKV (isolate Z1106033) prME-short variant mRNA Design 2 opt
ggggcgcugccuacggagguggcagccaucuccuucucggcaucaagcuuaccaugggcagaaagcagaacaaacgcgggggaaaugagggcagcaucauguggcuggccucccucgcuguggucauugccugcgcgggggcuguuacccggagaggaucugccuacuauauguaccuggaccggaacgaugccggcgaagcuaucagcuuccccacaacgcuugggaugaauaaguguuauauucaaaucauggaccugggacacacgugcgaugccacaauguccuacgaguguccuaugcucgacgaaggcguggagccggaugacguggauugcugguguaacaccacaucuaccugggucguguauggcacaugccaucacaaaaagggggaagcucgcagaagccggcgcgccguuacccugcccucccauucuacgagaaaacuucagacccggagccagacauggcuggagucccgcgaguacaccaagcaccucauuagaguggaaaauuggaucuuucggaacccuggauucgcgcuggccgcugccgcuaucgccuggcugcucggcagcucuacaucccagaaggucauuuaucuggugaugauccuucugauugcgcccgccuacagcauccgcuguauugggguuucuaauagagacuuuguggagggaauguccggcgggaccugggucgauguggugcucgaacauggaggcugcgucacgguuauggcucaagacaaaccuacaguggauaucgagcuggugaccacaaccgucagcaacauggccgaggugcggucuuacuguuaugaggcuuccauuagcgacauggccuccgauucucgcugccccacccagggcgaagccuaccuugacaagcagagcgacacacaguauguuuguaaaagaacgcugguggaucggggguggggaaauggcugcgggcuguucggaaagggcucccuggugaccugcgcuaaauuugcguguagcaagaagaugacagggaaaucuauccaaccugaaaaccuggaguacagaaucaugcucuccguccacggaagccagcacucuggcaugauuguuaaugacaccggccaugaaacagaugagaaccgcgccaagguggagaucaccccgaauagcccccgggcugaagccacgcucgggggauucggcucccuugggcuggacugcgagccuagaacaggacucgauuuuucugaccuguauuaccuuaccaugaacaauaaacacuggcugguccauaaggaaugguuccacgauauuccccucccuuggcacgccggcgcugacaccgggacaccccauuggaacaacaaagaggcccugguggaauuuaaggaugcgcacgcuaaacgccagaccgucgugguucugggcagccaggagggagccgugcauacagcccucgcuggcgcccuggaggcugaaauggacggggccaagggacggcuuuccagcggccaccugaaguguagacucaaaauggauaagcugcgccuuaaaggggucucuuauucccugugcacggcggccuucaccuuuacaaagaucccggcugagacccuccauggaacagugaccguugaagugcaauacgccggcacggacgggccuuguaaaguccccgcucagauggccguggacaugcagacccugacaccugugggccggcugauuaccgcgaaucccguuaucacagagagcaccgaaaacucuaagaugaugcucgagcuggaucccccuuucggagacuccuacaucgucauuggcgugggggagaagaaaaucacgcaccacuggcauagaagcggauccacacuuggcaaggccuuuucuaccacacugaaaggggcucaacgccucgccgcucugggagauaccgccugggacuucggcagcauugggggcguguucaauuccaucggacgggccguccaccagguguuuggcggggcuuucagaacccuguuuggaggcaugucuuggauuacacaggggcuuaugggagcgcuccugcuguggaugggcguuaacgcccgcgaucggagcaucgcucucgccuuccuggccaccgggggcgugcuugucuuucuggcuaccaaugugcaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11506 - RNA, 2473 nt, Artificial Sequence
  ZIKV (strain MR 766) prME-short variant mRNA Design 2 opt
ggggcgcugccuacggagguggcagccaucuccuucucggcaucaagcuuaccaugggcagaaagcagaacaaacggggcggaaaugagggcagcaucauguggcuggccucccucgcuguggucauugccugcgcgggggcuaucacccgcagaggaucugccuacuauauguaccuggaccggagcgaugccggcaaggcuauuuccuucgccacaacgcuugggguuaacaaaugucacgugcaaaucauggaccugggacauaugugcgaugcuaccaugucuuaugaaugucccaugcucgacgagggcguggaacccgaugacgucgauugcugguguaauacaaccagcacaugggugguuuacgggaccugccaccauaagaaaggggaggcccgcagaucccggcgcgcggugacacugccgucucacagcaccagaaagcugcagacgcggucccagaccuggcuggaaagccgcgaguauacaaagcaucucauuaaagucgagaacuggaucuuuagaaaucccggauucgcccugguggcuguugccaucgcuuggcugcucgggucuuccaccagccagaaggugauuuaccuggucaugauccuucugauugccccugcguauucuauccgguguauugggguguccaaccgcgacuuuguggaaggaaugagcggcgggacaugggucgauguugugcucgagcacggaggcugcgugaccgucauggcccaagacaaacccacgguggauaucgaacugguuacaaccacagugucuaauauggcugaggucagauccuacuguuacgaggccagcauuuccgacauggcuucugauagccggugcccuacccagggcgaagccuaucuugacaagcaguccgacacccaguacguguguaaacgcacacugguugauagaggguggggaaacggcugcggccucuucggaaagggcagccuggugacgugcgccaaguuuaccuguucuaaaaagaugacagggaaauccauccaacccgagaaucuggaauaucggaucaugcucagcguccacggaucucagcauagcggcaugauuggcuacgagaccgacgaagauagagcuaagguggaggucacaccuaacuccccgcgcgcggaggccacccuugggggauucggcucucuugggcuggacugcgaaccccggacgggacucgauuuuagcgaccuguauuaccuuacaaugaauaacaaacacuggcuggugcauaaggagugguuccacgauaucccucuccccuggcacgcuggcgccgacaccgggaccccucauuggaauaacaaagaagcccugguugaguuuaaggaugcucacgccaagagacagacaguggucgugcugggcucccaggaaggagcgguucauaccgcucucgccggcgcccuggaggcugagauggacggggccaaaggacgccuuuucagcggccaccugaagugucggcucaaaauggauaagcugagacuuaaaggggugucuuauucccugugcacagcugccuuuacguucaccaagguccccgcggaaacacuccauggaaccgugacaguggagguucaauacgccggcaccgacgggccguguaagauuccuguccagauggcuguggacaugcagacgcugacccccgugggccgccugaucacagccaauccugucauuaccgaaagcacagagaacucuaaaaugaugcucgaacuggauccucccuuuggagacuccuacaucgugaucggcguuggggauaagaaaauuacccaccacuggcaucggagcggauccacgcuuggcaaggcuuucucuacaacccugaaaggggcccaaagacucgcggcccugggagacacagcuugggauuucggcagcaucgggggcguguuuaacuccauuggacgcgccguccaccagguguucggcggggcuuuucggacccuguucggaggcaugucuuggaucacccaggggcuuaugggagcccuccugcuguggaugggcguuaaugccagagaccgcagcauugcucucgcguuucuggccacagggggcgugcuugucuuccuggcuacgaacgugcaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11507 - RNA, 2485 nt, Artificial Sequence
  ZIKV (strain NatalRGN) prME-short variant mRNA Design 2 opt
ggggcgcugccuacggagguggcagccaucuccuucucggcaucaagcuuaccaugggcagaaagcagaacaaacggggcggaaaugagggcagcaucauguggcuggccucccucgcuguggucauugccugcgcgggggcuguuacccgcagaggaucugccuacuauauguaccuggaccggaacgaugccggcgaagcuaucagcuuccccacaacgcuugggaugaauaaguguuauauucaaaucauggaccugggacacaugugcgaugccaccauguccuacgaguguccuaugcucgacgaaggcguggagccggaugacguggauugcugguguaacacaaccucuacaugggucguguaugggaccugccaucacaaaaagggggaagcucgcagaagccggcgcgccguuacacugcccucccauucuaccagaaaacuucagacgcggagccagaccuggcuggagucccgcgaguacacaaagcaccucauuagaguggaaaauuggaucuuucggaacccuggauucgcgcuggccgcugccgcuaucgccuggcugcucggcagcucuaccucccagaaggucauuuaucuggugaugauccuucugauugcgcccgccuacagcauccgcuguauugggguuucuaauagagacuuuguggagggaauguccggcgggacaugggucgauguggugcucgaacauggaggcugcgucaccguuauggcucaagacaaaccuacgguggauaucgagcuggugacaaccacagucagcaacauggccgaggugcggucuuacuguuaugaggcuuccauuagcgacauggccuccgauucucgcugccccacccagggcgaagccuaccuugacaagcagagcgacacccaguauguuuguaaaagaacacugguggaucggggguggggaaauggcugcgggcuguucggaaagggcucccuggucacgugcgcuaaauuugcguguagcaagaagaugaccgggaaaucuauccaaccugaaaaccuggaguacagaaucaugcucuccgugcacggaagccagcacucuggcaugauuguuaaugacacaggccaugaaaccgaugagaaccgcgccaagguggagaucacaccgaauagcccccgggcugaagccacccucgggggauucggcucccuugggcuggacugcgagccuagaacgggacucgauuuuucugaccuguauuaccuuacaaugaacaauaaacacuggcugguccauaaggaaugguuccacgauauuccccucccuuggcacgccggcgcugacaccgggacaccccauuggaacaacaaagaggcccugguggaauuuaaggaugcgcacgcuaaacgccagaccgucgugguucugggcagccaggagggagccgugcauaccgcccucgcuggcgcccuggaggcugaaauggacggggccaagggacggcuuuccagcggccaccugaaguguagacucaaaauggauaagcugcgccuuaaaggggucucuuauucccugugcacagcggccuucacguuuaccaagaucccggcugagacacuccauggaaccgugacaguugaagugcaauacgccggcaccgacgggccuuguaaaguccccgcucagauggccguggacaugcagacgcugaccccugugggccggcugauuacagcgaaucccguuaucaccgagagcacagaaaacucuaagaugaugcucgagcuggaucccccuuucggagacuccuacaucgucauuggcgugggggagaagaaaaucacccaccacuggcauagaagcggauccacgcuuggcaaggccuuuucuacaacccugaaaggggcucaacgccucgccgcucugggagauacagccugggacuucggcagcauugggggcguguucaauuccaucggacgggccguccaccagguguuuggcggggcuuucagaacccuguuuggaggcaugucuuggauuacccaggggcuuaugggagcgcuccugcuguggaugggcguuaacgcccgcgaucggagcaucgcucucgccuuccuggccacagggggcgugcuugucuuucuggcuacgaaugugcaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11508 - RNA, 2458 nt, Artificial Sequence
  ZIKV (strain ZikaSPH2015) prME-short variant mRNA Design 2 opt
ggggcgcugccuacggagguggcagccaucuccuucucggcaucaagcuuaccaugaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacacaugugcgaugccaccauguccuacgaguguccuaugcucgacgaaggcguggagccggaugacguggauugcugguguaauacaaccucuacaugggucguguaugggaccugccaucacaaaaagggagaagcuagacggagccgcagagccguuacacugcccucccauucuacccggaaacuucaaacgcgcagccagaccuggcuggaguccagagaguacacaaagcaccucauucggguggaaaacuggaucuuucgcaauccuggcuucgcgcuggccgcugccgcuaucgccuggcugcucggcagcucuaccucccagaaagucauuuaucuggugaugauccuucugauugcgcccgccuacagcaucagauguauugggguuucuaaccgggacuuuguggagggaauguccggcgggacaugggucgauaucgugcucgaacauggaggcugcgugaccgucauggcucaggacaagccuacgguugauauugagcuggugacaaccacagugagcaauauggccgagguccgcucuuacuguuaugaggcuuccaucagcgacauggccuccgauucuagaugccccacccaaggggaagccuaccuugacaagcagagcgacacccaguauguguguaaacggacacugguugaucgcggauggggcaacggcugcggacucuucgggaagggcucccuggugacgugcgcuaaauuugcguguagcaagaaaaugaccgggaagucuauccagccugaaaaucuggaguacagaauuaugcucuccguccacggaagccaacacucuggcaugaucgugaacgacacagggcaugaaaccgaugagaaucgggccaagguugagauuacaccgaacagccccagagcugaagccacccugggaggcuucggcucccuugggcuggacugcgagccucgcacgggacucgauuuuucugaccuguauuaccuuacaaugaauaacaaacacuggcuggugcauaaggaaugguuccacgauaucccccucccuuggcacgccggcgcugacaccgggacaccccauuggaauaacaaagaggcccuggucgaauuuaaggaugcgcacgcuaaacggcagaccguggucgugcugggaagccaggagggcgccguucauaccgcccucgcuggggcccuggaggcugaaauggacggcgccaagggaagacuuuccagcggccaccugaaaugucgccucaagauggauaagcugcggcuuaaaggggugucuuauucccugugcacagcggccuucacguuuaccaagauuccggcugagacacuccauggaaccgucacaguggaaguucaguacgccggcaccgacgggccuuguaaagugcccgcucaaauggccgucgacaugcagacgcugaccccugugggaagacugaucacagcgaaccccgugaucaccgagagcacagaaaauucuaagaugaugcucgagcuggaucccccuuucggcgacuccuacauuguuaucggggucggcgagaaaaagauuacccaccacuggcaucgcagcggauccacgcuuggcaaggccuuuucuacaacccugaaaggggcucagcggcucgccgcucugggagauacagccugggacuucggcagcaucgggggaguguucaacuccauuggcagagccgugcaccaagucuuugggggcgcuuuccgcacccuguuuggaggcaugucuuggaucacccaggggcuuaugggagcgcuccugcuguggaugggcgugaaugcccgggauagaagcaucgcucucgccuuccuggccacagggggaguucuuguguuucuggcuacgaacguccaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11509 - RNA, 2458 nt, Artificial Sequence
  ZIKV (isolate Z1106033) prME-short variant mRNA Design 2 opt
ggggcgcugccuacggagguggcagccaucuccuucucggcaucaagcuuaccaugaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacacacgugcgaugccacaauguccuacgaguguccuaugcucgacgaaggcguggagccggaugacguggauugcugguguaauaccacaucuaccugggucguguaugggacaugccaucacaaaaagggagaagcuagacggagccgcagagccguuacccugcccucccauucuacgcggaaacuucaaacccgcagccagacauggcuggaguccagagaguacaccaagcaccucauucggguggaaaacuggaucuuucgcaauccuggcuucgcgcuggccgcugccgcuaucgccuggcugcucggcagcucuacaucccagaaagucauuuaucuggugaugauccuucugauugcgcccgccuacagcaucagauguauugggguuucuaaccgggacuuuguggagggaauguccggcgggaccugggucgauguggugcucgaacauggaggcugcgucacgguuauggcucaggacaagccuacaguggauaucgagcuggugaccacaaccgucagcaauauggccgaggugcgcucuuacuguuaugaggcuuccauuagcgacauggccuccgauucuagaugccccacccaaggggaagccuaccuugacaagcagagcgacacacaguauguuuguaaacggacgcugguggaucgcggauggggcaacggcugcggacucuucgggaagggcucccuggugaccugcgcuaaauuugcguguagcaagaaaaugacagggaagucuauccagccugaaaaucuggaguacagaaucaugcucuccguccacggaagccaacacucuggcaugauuguuaacgacaccgggcaugaaacagaugagaaucgggccaagguggagaucaccccgaacagccccagagcugaagccacgcugggaggcuucggcucccuugggcuggacugcgagccucgcacaggacucgauuuuucugaccuguauuaccuuaccaugaauaacaaacacuggcugguccauaaggaaugguuccacgauauuccccucccuuggcacgccggcgcugacaccgggacaccccauuggaauaacaaagaggcccugguggaauuuaaggaugcgcacgcuaaacggcagaccgucgugguucugggaagccaggagggcgccgugcauacagcccucgcuggggcccuggaggcugaaauggacggcgccaagggaagacuuuccagcggccaccugaaaugucgccucaagauggauaagcugcggcuuaaaggggucucuuauucccugugcacggcggccuucaccuuuacaaagaucccggcugagacccuccauggaacagugaccguugaagugcaguacgccggcacggacgggccuuguaaaguccccgcucaaauggccguggacaugcagacccugacaccugugggaagacugauuaccgcgaaccccguuaucacagagagcaccgaaaauucuaagaugaugcucgagcuggaucccccuuucggcgacuccuacaucgucauuggggugggcgagaaaaagaucacgcaccacuggcaucgcagcggauccacacuuggcaaggccuuuucuaccacacugaaaggggcucagcggcucgccgcucugggagauaccgccugggacuucggcagcauugggggaguguucaacuccaucggcagagccguccaccaaguguuugggggcgcuuuccgcacccuguuuggaggcaugucuuggauuacacaggggcuuaugggagcgcuccugcuguggaugggcguuaaugcccgggauagaagcaucgcucucgccuuccuggccaccgggggagugcuugucuuucuggcuaccaacgugcaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11510 - RNA, 2446 nt, Artificial Sequence
  ZIKV (strain MR 766) prME-short variant mRNA Design 2 opt
ggggcgcugccuacggagguggcagccaucuccuucucggcaucaagcuuaccaugaacgagggcagcaucauguggcuggccucccucgcuguggucauugccugcgcgggggcuaucaccagacggggaucugccuacuauauguaccuggaccgcagcgaugccggcaaggcuauuuccuucgccacaacgcuugggguuaauaaaugucacgugcagaucauggaccugggacauaugugcgaugcuaccaugucuuaugaaugucccaugcucgacgagggcguggaacccgaugacgucgauugcugguguaacacaaccagcacaugggugguuuacgggaccugccaccauaagaaaggagaggccagacggucccgcagagcggugacacugccgucucacagcacccggaaacuucaaacgcgcucccagaccuggcuggaaagcagagaguauacaaagcaucucauuaaggucgagaauuggaucuuucggaaccccggcuucgcccugguggcuguugccaucgcuuggcugcucgggucuuccaccagccagaaggugauuuaccuggucaugauccuucugauugccccugcguauucuauccgcuguauugggguguccaauagagacuuuguggaaggaaugagcggcgggacaugggucgauguugugcucgagcacggaggcugcgugaccgucauggcccaggacaaacccacgguggauaucgaacugguuacaaccacagugucuaacauggcugagguccgguccuacuguuacgaggccagcauuuccgacauggcuucugauagccgcugcccuacccaaggggaagccuaucuugacaagcaguccgacacccaguacguguguaaaagaacacugguugaucggggauggggcaauggcugcggccucuucggaaagggcagccuggugacgugcgccaaauuuaccuguucuaagaagaugacagggaaauccauccagcccgagaaccuggaauaucgcaucaugcucagcguccacggaucucaacauagcggcaugauuggguacgagaccgacgaagauagagcuaagguggaggucacaccuaauuccccgcgggcggaggccacccugggaggcuucggcucucuugggcuggacugcgaacccagaacgggacucgauuuuagcgaccuguauuaccuuacaaugaacaauaaacacuggcuggugcauaaggagugguuccacgauaucccucuccccuggcacgcuggcgccgacaccgggaccccucauuggaacaauaaagaagcccugguugaguuuaaggaugcucacgccaaacgccagacaguggucgugcugggaucccaggaaggcgcgguucauaccgcucucgccggggcccuggaggcugagauggacggcgccaagggacggcuuuucagcggccaccugaaguguagacucaaaauggauaagcugcgccuuaaaggggugucuuauucccugugcacagcugccuuuacguucaccaagguccccgcggaaacacuccauggaaccgugacaguggagguucaguacgccggcaccgacgggccguguaaaauuccuguccaaauggcuguggacaugcagacgcugacccccgugggacggcugaucacagccaacccugucauuaccgaaagcacagaaaauucuaagaugaugcucgagcuggauccucccuuuggcgacuccuacaucgugaucgggguuggcgauaagaaaauuacccaccacuggcauagaagcggauccacgcuuggcaaggcuuucucuacaacccugaaaggggcccagcgccucgcggcccugggagacacagcuugggauuucggcagcaucgggggaguguuuaacuccauuggccgggccguccaccaaguguucgggggcgcuuuuagaacccuguucggaggcaugucuuggaucacccaggggcuuaugggagcccuccugcuguggaugggcguuaacgcccgcgaccggagcauugcucucgcguuucuggccacagggggagugcuugucuuccuggcuacgaaugugcaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11511 - RNA, 2458 nt, Artificial Sequence
  ZIKV (strain NatalRGN) prME-short variant mRNA Design 2 opt
ggggcgcugccuacggagguggcagccaucuccuucucggcaucaagcuuaccaugaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacacaugugcgaugccaccauguccuacgaguguccuaugcucgacgaaggcguggagccggaugacguggauugcugguguaauacaaccucuacaugggucguguaugggaccugccaucacaaaaagggagaagcuagacggagccgcagagccguuacacugcccucccauucuacccggaaacuucaaacgcgcagccagaccuggcuggaguccagagaguacacaaagcaccucauucggguggaaaacuggaucuuucgcaauccuggcuucgcgcuggccgcugccgcuaucgccuggcugcucggcagcucuaccucccagaaagucauuuaucuggugaugauccuucugauugcgcccgccuacagcaucagauguauugggguuucuaaccgggacuuuguggagggaauguccggcgggacaugggucgauguggugcucgaacauggaggcugcgucaccguuauggcucaggacaagccuacgguggauaucgagcuggugacaaccacagucagcaauauggccgaggugcgcucuuacuguuaugaggcuuccauuagcgacauggccuccgauucuagaugccccacccaaggggaagccuaccuugacaagcagagcgacacccaguauguuuguaaacggacacugguggaucgcggauggggcaacggcugcggacucuucgggaagggcucccuggucacgugcgcuaaauuugcguguagcaagaaaaugaccgggaagucuauccagccugaaaaucuggaguacagaaucaugcucuccgugcacggaagccaacacucuggcaugauuguuaacgacacagggcaugaaaccgaugagaaucgggccaagguggagaucacaccgaacagccccagagcugaagccacccugggaggcuucggcucccuugggcuggacugcgagccucgcacgggacucgauuuuucugaccuguauuaccuuacaaugaauaacaaacacuggcugguccauaaggaaugguuccacgauauuccccucccuuggcacgccggcgcugacaccgggacaccccauuggaauaacaaagaggcccugguggaauuuaaggaugcgcacgcuaaacggcagaccgucgugguucugggaagccaggagggcgccgugcauaccgcccucgcuggggcccuggaggcugaaauggacggcgccaagggaagacuuuccagcggccaccugaaaugucgccucaagauggauaagcugcggcuuaaaggggucucuuauucccugugcacagcggccuucacguuuaccaagaucccggcugagacacuccauggaaccgugacaguugaagugcaguacgccggcaccgacgggccuuguaaaguccccgcucaaauggccguggacaugcagacgcugaccccugugggaagacugauuacagcgaaccccguuaucaccgagagcacagaaaauucuaagaugaugcucgagcuggaucccccuuucggcgacuccuacaucgucauuggggugggcgagaaaaagaucacccaccacuggcaucgcagcggauccacgcuuggcaaggccuuuucuacaacccugaaaggggcucagcggcucgccgcucugggagauacagccugggacuucggcagcauugggggaguguucaacuccaucggcagagccguccaccaaguguuugggggcgcuuuccgcacccuguuuggaggcaugucuuggauuacccaggggcuuaugggagcgcuccugcuguggaugggcguuaaugcccgggauagaagcaucgcucucgccuuccuggccacagggggagugcuugucuuucuggcuacgaacgugcaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11512 - RNA, 2485 nt, Artificial Sequence; identical to SEQ ID NO: 11496
  ZIKV (strain ZikaSPH2015) ME variant mRNA Design 2 opt

SEQ ID NO: 11513 - RNA, 2485 nt, Artificial Sequence; identical to SEQ ID NO: 11497
  ZIKV (isolate Z1106033) ME variant mRNA Design 2 opt

SEQ ID NO: 11514 - RNA, 2473 nt, Artificial Sequence; identical to SEQ ID NO: 11498
  ZIKV (strain MR 766) ME variant mRNA Design 2 opt

SEQ ID NO: 11515 - RNA, 2485 nt, Artificial Sequence; identical to SEQ ID NO: 11499
  ZIKV (strain NatalRGN) ME variant mRNA Design 2 opt

SEQ ID NO: 11516 - RNA, 2458 nt, Artificial Sequence; identical to SEQ ID NO: 11500
  ZIKV (strain ZikaSPH2015) ME variant mRNA Design 2 opt

SEQ ID NO: 11517 - RNA, 2458 nt, Artificial Sequence; identical to SEQ ID NO: 11501
  ZIKV (isolate Z1106033) ME variant mRNA Design 2 opt

SEQ ID NO: 11518 - RNA, 2446 nt, Artificial Sequence; identical to SEQ ID NO: 11502
  ZIKV (strain MR 766) ME variant mRNA Design 2 opt

SEQ ID NO: 11519 - RNA, 2458 nt, Artificial Sequence; identical to SEQ ID NO: 11503
  ZIKV (strain NatalRGN) ME variant mRNA Design 2 opt

SEQ ID NO: 11520 - RNA, 2485 nt, Artificial Sequence
  ZIKV (strain ZikaSPH2015) prME-short variant mRNA Design 2 opt
ggggcgcugccuacggagguggcagccaucuccuucucggcaucaagcuuaccaugggaagaaaacaaaacaaaagaggcggcaaugaaggaagcauuaugugguuagcaucacuagcaguaguaauagcaugugcgggcgcaguuacacgcagagguagugcauacuacauguaucuagauagaaaugaugcaggagaagcaauaucauuucccaccacauuaggaaugaauaaauguuauauucaaauaauggaucuaggacauaugugcgaugcaaccaugucauacgaaugccccaugcuagaugaaggaguagaacccgacgacguagauugcuggugcaauacgacuucaacauggguaguauacgggacaugccaucauaagaaaggggaagcccgaagaaguaggagagcaguaacacuaccuucucauucaacuagaaaauuacaaacuagaagucaaacuuggcuugaaucaagagaauauacaaaacaucuaauuagaguugaaaacuggauauucagaaacccagguuucgcauuagcugcugccgcgauagcaugguuauuaggcucaaguacuucacaaaaaguaauuuauuugguuaugauauuauuaauugcuccagcuuacucuauaagauguauaggugucagcaaucgagauuucguugaaggaaugucuggggguacaugggucgacauaguccuagaacaugggggauguguaacagugauggcacaagauaaaccuacaguugacauagaauuagugacaacaacugucucaaauauggcggagguaagauccuacuguuaugaagcaucaaucucagauauggcaagugacagcagaugcccaacccaaggugaagcauaccuugacaaacaaagcgacacccaauauguauguaaacguacauuaguagauagaggguggggaaacggguguggauuauuuggaaagggaagucuaguaacaugugcaaaauucgcauguuccaagaaaaugacaggaaaaucaauacaaccagaaaauuuggaauauagaauaauguuaucaguucacggaucacaacacucgggaaugauuguaaacgauacuggacaugaaacagacgaaaauagagcaaaaguagaaauaacuccaaacucaccgagagcagaagcaacacucggugguuucggaucauuaggauuggauugugaaccaaggaccggacuggacuucucagauuuauacuacuuaacaaugaauaauaaacauuggcugguacauaaagaaugguuccacgacauaccauuaccauggcaugcaggagcagauacaggaacaccacacuggaauaauaaagaagcucuaguugaguuuaaagaugcucaugcaaaaagacaaacagucguuguauuagggagucaagaaggagcgguucauacagcauuagcaggagcauuggaagccgaaauggacggagcaaaaggaagauuaaguucaggccacuuaaaauguagauugaaaauggacaaauuaagacuaaaaggaguaucguauagccuaugcacagcagcauuuacauuuacaaaaauaccagcagaaacccuacaugguacaguaacaguagaaguucaauacgcaggaacagaugguccuuguaaaguuccagcccagauggcaguagauaugcagacauuaacaccagucggcagauuaauaacagccaauccgguaauaacagaaucaacagaaaauagcaaaaugauguuagaacuagacccacccuuuggcgauucauauauaguaauagguguaggagaaaagaaaauaacucaucacuggcaucgaaguggaucaacuauagguaaagcauuugaagcaacaguacgcggagcaaaaagaauggcuguauuaggagauacggccugggacuuugguucaguugguggagcacuaaacucacuaggcaaaggaauacaucaaauuuuuggcgcagcuuucaaaucauuauuuggaggaaugucuugguucucacaaauauuaauaggaacauuauuaaugugguuaggauuaaacacuaaaaauggaucaauaaguuugaugugccuagcuuuaggugguguacuaauauuucuaucaacagcaguuucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11521 - RNA, 2485 nt, Artificial Sequence
  ZIKV (isolate Z1106033) prME-short variant mRNA Design 2 opt
ggggcgcugccuacggagguggcagccaucuccuucucggcaucaagcuuaccaugggacguaaacaaaauaaaagagguggaaaugaaggaaguauuaugugguuggcaagcuuagcaguaguaauagcaugcgcgggggcuguaacuaggaggggaagugcauacuacauguaucuagacagaaacgaugcaggugaagcaauuaguuuuccuacuacauuaggcaugaauaaauguuacauacaaaucauggauuuaggacauacaugugaugcaacuaugaguuaugaauguccuauguuagaugaaggcguugaaccagaugacguagacuguugguguaauacaacaaguacuuggguaguauaugggacgugucaucacaaaaaaggagaagcaagaagaucaagaagagcuguuacacuuccaagucauucgacaagaaaacuacagacaagaucucagacuuggcuagaaagcagagaauauaccaaacauuuaauuagaguagagaauuggauauuuagaaauccaggauucgcauuagcagcagcugcaauagcaugguuauuaggaagcaguacgucacaaaagguaauauaccuaguaaugauauuauuaauagcaccugcauacaguauaagaugcauaggaguaaguaacagagauuuuguagaaggcaugagugguggaacauggguagaugucguacuugagcaugguggguguguaacuguaauggcacaagauaaaccaacaguagacaucgaauuagugacaacaacaguaagcaauauggcagaaguacggucauauuguuacgaagcgaguaucucugacauggcaucagauaguagaugucccacacaaggggaagcuuauuuagauaaacaaucagauacacaauacguauguaaaagaacguuaguggaucgcggauggggaaauggauguggacuauucggcaaaggauccuuaguaacaugugcgaaauucgcaugcucaaaaaaaaugacaggaaaaucaauacaaccagaaaauuuagaauaucguauuaugcuaaguguacauggaucucaacacagcggaaugauaguaaacgauacuggacacgaaacagacgaaaauagggcaaaaguggaaauuacacccaauucaccaagagcagaagcuacuuuaggagguuuuggaaguuuagguuuagacugcgaaccgcguacaggauuagauuuuagugacuuauauuaucugacuaugaauaauaaacauugguuaguucauaaagaaugguuucaugauauaccacuuccuuggcaugcgggagcagacacaggaacaccacacuggaauaauaaagaagcauuagucgaauuuaaagaugcacaugcaaaaaggcaaacaguaguaguacuaggaucacaagaaggagcuguacauacagcacuagcaggagcauuagaagcagaaauggauggugcaaaaggaagacuuagcucuggacauuuaaaaugcaggcuaaaaauggacaaauugagauuaaaaggcguaucauauucguuauguacagccgcguuuaccuuuacaaaaauaccagcagaaacacuacacgguacaguuacaguagaaguacaauacgcaggaacagacggaccuuguaaaguaccagcacaaauggcagucgacaugcagacauuaacaccaguagguagacuaauuacagcaaauccaguaauaacagaaucuacagaaaacucaaaaaugauguuagaauuagaucccccauuuggagauaguuauauuguuauaggaguaggggaaaaaaaaauaacacaucauuggcacaggucagggaguacaauaggaaaagccuuugaggcaaccguaagaggagcaaaaagaauggcaguauuaggagauacagcaugggauuuuggaaguguaggaggagcgcuaaauagucuaggcaaaggaauucaucaaauuuucggagccgcauucaaaucauuauuuggaggaaugagcugguuuucucaaauacuaauugguacuuuauuaaugugguuaggauuaaacgcaaaaaauggaagcauaaguuugaugugcuuagcacuagguggaguauuaauauuucugagcacagcaguaagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11522 - RNA, 2473 nt, Artificial Sequence
  ZIKV (strain MR 766) prME-short variant mRNA Design 2 opt
ggggcgcugccuacggagguggcagccaucuccuucucggcaucaagcuuaccaugggaagaaaacaaaauaaaaggggugguaaugaagguucuaucaugugguuagcaucguuagcaguagugauagcuugugcaggagcuauaacaagacgaggaucagcauacuauauguacuuagacagaagugacgcaggaaaagcaauuucauuugcuaccacauuaggaguaaauaaaugccauguacaaauaauggauuuaggacacaugugugacgcaacaauguccuaugaaugcccuauguuggaugaagguguugaaccagaugauguugauugcugguguaauacgacaaguacuuggguuguuuauggaacaugccaucauaagaaaggagaagcaaggagaucaagacgagcagucacacuaccaucacacucaacaagaaaacuacaaacacgcucacaaacauggcuagaaagcagagaauauacaaaacauuuaauaaaaguggagaauuggaucuuuagaaauccaggguuugcgcuuguagcuguagcaauagcaugguugcuuggaaguucuacaagccaaaaaguuauauaucuaguaaugauauuauugauagcaccagcguauucaauaagauguauuggaguaagcaauagagauuuuguagaaggcaugucaggaggaacauggguagacguaguucucgaacauggaggcuguguaacaguaauggcacaagauaaaccuacgguggacauagaguuaguaacaacaacaguauccaauauggcugagguucgaucauauugcuacgaagcaagcauaucagacauggccagcgauucaagauguccaacucaaggggaagcauaucuugauaaacaaagcgacacgcaauacguauguaaaagaacucuaguagauaggggauggggaaaugguuguggauuauuuggaaaaggaucauuaguaacaugugcuaaauuuacauguucaaagaaaaugacaggaaaaaguauacaaccugaaaauuuggaauacagaauaauguuaagcguacauggaagccaacauucaggaaugaucggauaugaaacagaugaagauagagccaaaguagaagugacaccaaauucaccuagagccgaagcgacacuugggggauucggaagucuaggauuagacugugaaccuagaacaggacuagauuuuagcgaccuauauuauuuaacaaugaacaacaaacauuggcuaguacauaaagaaugguuccaugauauaccauuaccauggcacgcaggagcagauacuggaaccccacacuggaauaauaaagaggcccugguagaguucaaagacgcucaugcaaaaagacaaacaguggucguuuuaggaucacaagaaggagcgguacauacugcccuagcuggagcucuagaagcagaaauggauggagcuaaaggaagguuauuuucgggacauuuaaaauguagacuaaaaauggauaaauuacgacuaaaggguguauccuauaguuuauguacagccgcuuuuacauuuacuaagguuccggcagaaacauuacacgggacuguaacaguagaaguacaauaugcgggaacagauggaccguguaaaaucccgguucaaauggcaguagauaugcaaacauuaacaccaguuggaagauuaauaacagcuaacccagugauaacagaaaguacagaaaacagcaaaaugauguuagaauuagauccaccauuuggagauaguuauauaguuauaggaguaggagauaagaaaauaacacaccauuggcauagaucugguagcacaauaggaaaagcauuugaagcaaccguucgaggagcaaaaagaauggcaguauuaggagauacugcaugggauuuugggagcguaggaggaguauuuaacucauuaggaaaaggaauacaucaaauauuuggagcagcauucaaaucgcuauuuggaggaaugaguugguuuagccaaauacuaauugggacucuauuaguaugguuaggacuaaauaccaaaaauggaagcauaaguuuaacaugccuagcauugggaggaguaaugauauuuuuaagcacagccguuucagccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11523 - RNA, 2485 nt, Artificial Sequence
  ZIKV (strain NatalRGN) prME-short variant mRNA Design 2 opt
ggggcgcugccuacggagguggcagccaucuccuucucggcaucaagcuuaccauggguagaaaacaaaacaaaagagguggaaaugaaggaucaauaaugugguuagcuucacuagcagucguaaucgcuugugcaggagcuguaacuagaagaggaagugcauauuauauguaccuagauagaaaugaugcaggagaagcuauuaguuuuccaacaacacuagguaugaauaaaugcuauauacaaaucauggaucuaggacauaugugugaugcaaccaugucauaugaauguccuaugcuugaugaagguguugagccggaugacguggauuguugguguaauacuacgaguacauggguaguguauggaacaugucaucauaaaaaaggagaagcccgccgaaguagaagggcaguaacgcuaccaagucauucuacaaggaaacuacaaacaagaucacaaacaugguuggaaucacgagaauauacgaagcaucuuauuagaguugaaaauuggauuuucaggaauccaggauucgcuuuagcggcggcagcaauagcuuggcuacuaggaaguaguacuucacaaaaaguaauauauuuaguaaugauacuauugaucgcaccggcauacucaauaagauguauaggaguuucaaauagagacuuuguagaaggaaugagcgguggcaccuggguugauguuguauuggaacacggaggaugcguaacagucauggcacaagauaaaccaacaguagauauagaauuaguaacaacaaccguaaguaauauggcagaaguacgaucauauuguuaugaggcaaguauaucugauauggcuucagacucacguuguccaacucaaggcgaagcauaccuagauaaacaaucagauacucaauacguaugcaaaagaacauuaguagauagaggguggggaaaugguuguggauuauucggaaaaggaucauuaguaacuugugcaaaauucgcaugcaguaaaaaaaugacaggaaaaaguauacaaccagaaaauuuagaauacagaauaauguuaaguguacacggaagccaacauaguggaaugauuguaaaugauacuggacaugaaacggacgaaaaccgugcuaaaguagagauaacaccaaauagcccgagagcagaggcaacauuagguggauuugguaguuuagguuuagacugcgaaccucguaccggguuagacuuuagugacuuauauuauuuaacaaugaauaacaaacauugguuagugcauaaagagugguuccacgauauaccucucccuuggcaugccggagcugacaccggaacaccacauuggaacaauaaagaagcauuaguagaauuuaaagacgcacacgcaaaaagacaaacaguaguuguauuaggaucacaagagggugccguacauacagcacuugccggagcauuagaagcugaaauggauggagcuaaagguagacuuucaucaggacauuuaaaauguagauuaaaaauggauaaauuaagacucaaaggagucucauacagucuuuguacagcugcauuuaccuuuaccaaaauuccagcagagacacuacauggaacaguaacuguagagguacaauaugcaggaacagauggaccauguaaaguaccugcacaaauggcaguagauaugcaaaccuuaacaccaguaggaagauuaauuacagcuaaucccguaauaacugaaaguacagaaaacaguaaaaugauguuagaauuagauccaccauuuggugauagcuauauaguuauaggaguaggcgaaaaaaaaauaacucaucauuggcauagaagcgguagcacaauuggaaaagcauuugaagcaacuguaagaggagcaaaaagaauggcuguacuaggagauacagcaugggauuuuggaagcguuggaggagcacuaaauucauuaggcaaaggaauacaucaaauauuuggagcagcauucaaaagcuuauucggaggaaugucaugguuuucgcaaaucuuaauaggaacuuuacuaaugugguuaggacuaaauacuaaaaacggaucuauuagcuuaaugugcuuagcacuaggaggaguguuaauuuucuugucaacagcuguaagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11524 - RNA, 2458 nt, Artificial Sequence
  ZIKV (strain ZikaSPH2015) prME-short variant mRNA Design 2 opt
ggggcgcugccuacggagguggcagccaucuccuucucggcaucaagcuuaccaugaaugaaggaucuauaauguggcuagcuagucuugcugucguuauugcaugugcaggagcaguaacgcgaagagguucagcauauuacauguauuuagauagaaaugaugcgggagaagcaauaucauuuccaacuacauuaggaaugaacaaauguuauauccaaaucauggauuuaggccauaugugugaugcuacaaugucauaugaaugcccuaugcucgaugaaggaguagaaccagaugauguagauuguugguguaauacaacaagcacauggguuguauauggaacaugucaucacaaaaaaggagaagcgcgaagaucacgaagggcuguaacauuaccgucacauucaacacgaaaauugcaaacaagaagucaaacauggcuagaaucccgugaauauacaaaacauuuaauaagaguagaaaauuggauauucagaaauccagguuucgcauuagcagcggcugcaauagcaugguuauuagguaguagcacaagucaaaaaguaaucuaucuaguaaugauacuucuaauagcaccugcauauucaauaagaugcauaggcguuagcaauagagacuucguagaagggaugucagguggcacguggguagacauagugcuagaacauggaggauguguaacagucauggcccaagauaaaccuacaguagauauugaacuaguuacaacuacaguuucaaauauggcugaaguaagaucauauuguuacgaagcaaguauuucagauauggcaucagauaguagaugcccaacacaaggugaagcauaccucgauaaacaaagcgacacgcaauauguauguaaaagaacccuaguugacagagguuggggaaacggaugcggauuauuugggaaagguucacuaguaacaugcgcaaaauuugcaugcucaaaaaaaaugacaggcaaaucaauacaacccgaaaaucuagaauacagaauuauguuaucaguccauggaagucaacauucaggaaugauagucaaugauacaggacaugaaacagaugaaaacagggcaaaaguagagauaacuccaaacucaccuagggcagaagcaacuuugggagguuucggaagcuuaggauuagacugcgaaccuagaacagguuuagauuuuagcgacuuauacuaucuuacaaugaacaauaagcacugguugguacauaaagagugguuucacgacauaccuuuaccauggcacgcaggugcagacacaggaacaccucauuggaauaauaaagaagcauuaguagaauuuaaagaugcacaugcaaaacgucaaacgguagucguacuaggcucccaagaaggagcgguacauaccgcacuugcaggcgcauuagaagcagaaauggauggagcaaaaggaagacuaagcucaggucaucuaaaauguagauugaagauggauaaauuaagauuaaaagggguuaguuacucguuauguacagcagcauuuacauucacaaaaauaccagcggaaaccuuacacggcacuguaacggucgaaguucaguaugcaggaacugaugguccauguaaaguaccagcacaaauggcaguagauaugcaaacauuaacaccuguaggaagguuaauuacugccaacccaguaauaacagaaaguacagagaauucaaaaaugaugcuagaacuagauccuccguucggagacaguuauauaguaauaggaguaggagaaaaaaaaauuacacaucauuggcauagaaguggaucaacaauaggcaaagcauucgaagcuacaguuagaggugcaaaaagaauggcaguacuaggcgacacagcaugggacuuuggaucaguugggggagcucuaaacagcuuaggaaaaggcauacaccaaauauucggagccgcuuuuaaaagucuguuuggaggcaugagcugguuuucacaaauucuuauaggaacauuguuaaugugguuaggauuaaauacgaaaaauggaucaauaucauuaaugugcuuagcacucggaggcguauuaauuuuuuuaucgacagccguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11525 - RNA, 2458 nt, Artificial Sequence
  ZIKV (isolate Z1106033) prME-short variant mRNA Design 2 opt
ggggcgcugccuacggagguggcagccaucuccuucucggcaucaagcuuaccaugaaugaaggaaguauaaugugguuagcuagucuugcaguaguaauagcuugcgcaggagccguaacaagaaggggaagugcauauuauauguacuuagauagaaacgaugcuggagaagcaauaaguuuuccaacaacauuaggaaugaacaaauguuauauacaaauaauggacuuaggucauacaugugaugcaacaauguccuaugaauguccuaugcuugacgaaggaguagaaccagaugauguagacuguugguguaacacaaccucuacauggguaguuuacgguaccugucaucauaaaaaaggggaagcaagaagaagccgucgugcaguuacacucccaagccacagcacuagaaaauuacaaacaagaagucaaacuugguuagaaucaagggaauacacaaaacacuuaauuagaguggaaaauuggauauucagaaauccuggauuugcucuggccgcugcagcaauagcuuggcuauuaggaucaagcacuagucaaaaaguuauauaucuaguaaugauauuacucauagcaccagcauauucaauaagauguauagguguaucaaacagggacuucguagaaggaaugagugguggaacauggguagauguaguacuagaacacggaggcugcgucacaguaauggcucaagauaaaccaacaguagauauagaacucguuacgacaacaguaaguaauauggcagaaguuagaaguuauuguuaugaagcaucaauaagugauauggcaagugacagcagaugcccaacacagggugaagcauaucuagacaaacaaucugauacacaauauguuugcaaaaggacauuaguugauagaggaugggguaauggauguggauuauuugguaaaggaaguuugguaaccugcgcaaaauucgcuuguucgaaaaaaaugaccggaaagucaauacagcccgaaaaccuagaauauagaauaaugcuuucaguacacggaucacagcauaguggcaugauagugaaugacacaggucaugaaacagacgaaaauagagcaaaaguagaaaucacaccaaauucaccacgagcugaagcaaccuugggaggauuuggcagcuuaggacuagauugugaaccaagaacuggauuagauuuuucagaucuauauuacuuaacaaugaacaacaaacauugguuagugcacaaagaaugguuucacgacaucccacuacccuggcacgcuggugcagacacagggacuccucauuggaacaacaaagaagcauuaguagaauuuaaagaugcucaugcaaaaagacaaaccguuguaguccuuggaagucaagaaggcgccguacacacagcauuagcuggagcacuagaagcggaaauggauggagcaaaaggaagacuaucaucaggacaucuaaaauguagauuaaaaauggauaaauuaagacuaaaagguguaaguuacaguuuauguacagcugcauuuaccuucacuaaaauucccgcagaaacacuccacggaacaguaacaguagaagugcaauacgcuggaacagauggaccauguaaaguaccugcacaaauggccguagacaugcaaacauuaaccccaguaggcagauugaucacagcuaacccaguaauaacugaaagcacagaaaauagcaaaaugauguuagaacuugauccuccguuuggcgauaguuauaucguaauagggguaggagaaaaaaaaauuacacaucauuggcauagaaguggaaguacaauaggaaaagcauuugaagcaacuguaagaggugcaaaaagaauggcaguauuaggugauacagcgugggauuuuggaucaguuggaggagcauuaaauaguuuaggaaaagguauacaucaaauauuuggagcugcguucaagucacuauuuggaggaaugaguugguuuagccaaauacuaauagguacgcuacuaaugugguugggcuuaaacgcaaaaaacggaaguauuucacuaauguguuuagcacuaggaggagugcuuauauuucuuaguacagcaguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11526 - RNA, 2446 nt, Artificial Sequence
  ZIKV (strain MR 766) prME-short variant mRNA Design 2 opt
ggggcgcugccuacggagguggcagccaucuccuucucggcaucaagcuuaccaugaaugaaggaucuauuaugugguuagcaucacuagcggugguaaucgcaugcgccggcgcaaucacaagaagaggaucagcauauuauauguaccucgaucgaucagaugcuggaaaagcaauaucauucgcaacaacauuaggaguuaauaaaugccauguacaaauuauggacuuaggacauaugugcgaugcaacuaugucauaugaauguccaaugcuagaugaaggaguggaaccagaugauguagauuguugguguaacacaacaagcacauggguaguuuacggaacuugucaucauaagaaaggagaagcgcgacgaucaaggagagcaguuacacuaccaagucacaguaccagaaaacuacagacaagaucacaaacaugguuagagaguagagaauauacgaaacaccucauaaaaguagaaaauuggauauucagaaauccaggauuugcucuaguugcagucgcaauagcaugguuauuaggaucaaguacgagucaaaaaguaauauacuuaguaaugauauuacuaauagcaccagcauauucuauuagaugcaucggaguuucaaauagagauuucgucgagggaaugucaggaggaacuuggguagaugugguauuagaacacggaggaugcguaacaguaauggcacaagacaaaccaacagucgauauagaauuagugacaacaacaguaagcaauauggcagaaguaagaucauauuguuaugaagccucaauaagcgauauggcgucagauucaagaugcccaacacaaggagaagcauacuuagacaaacaaucugacacacaauaugucugcaaaagaacucuagucgacaggggcugggguaacggaugcggauuauucgguaaaggaucauuaguaacaugugcaaaauucacauguaguaagaaaaugacuggcaaaagcauucaaccagaaaaucuagaauacaggauaaugcuaucaguacacggaagccaacacagcggaaugauaggauacgaaacagaugaagauagagcaaaaguagaaguaacaccgaacaguccacgagcugaagcgacauugggcggguucggaucauuaggauuagauugugaaccgagaacagguuuagauuuuagcgaccuguauuacuuaacaaugaauaauaaacauuggcuaguacauaaagaaugguuccaugauauaccacugccauggcaugcaggggcagauacagguacaccacacuggaauaacaaagaagcauugguagaauuuaaagaugcacaugccaaacgacaaacgguagugguauuagggucacaagagggagcuguacauacagcauuagcaggagcacuggaagccgaaauggauggugcaaaaggaagauuguucaguggacaucuaaaaugcagauugaaaauggauaaacuacgauuaaaagggguaucauauucacuauguacagcagcauuuacauuuacaaaagugccagccgaaacuuugcaugguacaguaacaguagaaguacaauaugcagguacagauggaccauguaaaauaccuguucagauggcagucgacaugcaaacacuuacaccuguuggaaggcuuauaacagcaaauccagugauaacagaaucaacagaaaauagcaaaaugaugcuagaacuagauccacccuuuggagauucauacauaguaauuggggucggagauaagaaaauaacucaucauuggcauagaucuggaagcacuauaggaaaggcuuucgaagcaacaguaagaggagcaaaaagaauggcaguauuaggagauacagcaugggauuuuggaagcguagguggaguauuuaauucguuaggaaaaggaauccaucaaauuuuuggagcagcauucaaaagucuauuuggagguaugucuugguuuagccaaauauuaauagguacauuacuuguauggcuaggacuaaauacuaaaaacgggucuauaaguuuaacaugcuuagcacuaggagggguaaugauauuuuuaagcacagcaguaagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11527 - RNA, 2458 nt, Artificial Sequence
  ZIKV (strain NatalRGN) prME-short variant mRNA Design 2 opt
ggggcgcugccuacggagguggcagccaucuccuucucggcaucaagcuuaccaugaaugaaggaucaauaauguggcuagccaguuuagcgguaguaaucgcaugugcuggagcaguaacaagaagaggaagcgcuuacuauauguauuuagacaggaacgaugcaggugaagccauaaguuuucccacaacacuaggaaugaacaaauguuauauucaaauaauggaucuaggacauaugugugaugcuacuaugaguuaugagugcccaaugcuagacgagggaguggaaccugaugacguagacugcuggugcaauacaacaagcacauggguaguuuauggaacaugucaccauaaaaaaggagaagcucggcgaucaagaagagcaguaacauuaccuagucauaguacgagaaaacuacaaacaaggagccaaacaugguuagaaucacgugaauacacaaaacauuuaauaagaguagagaacuggauauuuagaaacccaggcuuugcacuagcagcagcagcaauagcaugguuauuaggaucaucgacaagccaaaaaguaauauaucuagugaugauauuacuaaucgcaccagcauauagcauaagauguauaggaguuagcaauagagacuucguagaaggaaugucaggcggaacauggguagauguaguuuuagaacauggaggauguguaacaguaauggcucaagacaaaccaacagucgauauugaacuaguaaccacgacaguaagcaacauggcugaaguacgaucauauuguuaugaggcaagcauauccgacauggcaucggacucaagauguccaacacaaggugaagcauauuuggauaaacaaucagauacacaauauguguguaaaagaacuuuaguugaucgcggaugggguaacggaugugguuuauuuggaaaaggaucacuaguuacaugugcaaaauucgcaugcaguaaaaaaaugacgggaaaaagcauacaaccggaaaaucuagaauauagaauaauguugaguguacauggaucacaacauaguggaaugauaguaaaugauacaggccacgaaacagaugaaaauagagcaaaaguugaaauuacaccaaauagcccacgagcagaagcaacacuagggggauucggaagucuaggguuagacugcgaaccaagaacggguuuggauuuuagugaucuauauuaucuuaccaugaauaacaaacauuggcucguacauaaagaaugguuucaugauauaccauuacccuggcaugcaggagcagauaccgguacgccucauuggaauaauaaagaagcauugguagaauucaaggaugcacacgcgaaaaggcaaacuguaguaguauuaggaagccaagaaggagcaguacacacagcauuagcuggugcacuagaagcugaaauggauggagcaaaaggaagauuaaguucaggucauuuaaaauguagauuaaagauggauaaauuaagauuaaaagggguaaguuacucauuauguacugcggcauuuacauuuacaaaaauaccagcagagacucuacaugguacaguaacaguugaagugcaauaugcagguaccgauggaccauguaaaguaccagcacaaauggcaguugauaugcaaacacuuacaccagucgggagacuaauaacugcaaacccaguaauaacagaaucaacagaaaacaguaaaaugaugcuagaauuagauccaccauuuggagacaguuauauaguaauaggaguaggugaaaaaaaaauuacacaccacuggcacagaucaggaaguacgauaggaaaagccuuugaagcgacagugagaggagcaaaaagaauggcaguauuaggagacacagcaugggauuuugguaguguuggaggcgcucuaaauucacuagguaaaggaauacaucaaauauuuggagcagcauuuaaaagccuauuuggagggaugucaugguucagucaaauucuaauaggaacacuauuaaugugguuaggacuaaauacaaaaaacggaucaauaucuuuaaugugucuagcauuaggaggcguauuaauauuucuuagcacagcgguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11528 - RNA, 2485 nt, Artificial Sequence
  ZIKV (strain ZikaSPH2015) prME-short variant mRNA Design 2 opt
ggggcgcugccuacggagguggcagccaucuccuucucggcaucaagcuuaccaugggaaggaaacaaaauaaaagaggugguaaugaaggaucaauaaugugguuagcaucacuagcagucgucauagcuugcgcgggagcaguaacuagaagaggaucggcuuacuacauguauuuagauagaaaugaugcaggagaagcuauaucuuucccgacaacacucggaaugaauaaauguuauauccaaauuauggaucuuggacauaugugcgaugcaacaaugagcuaugaauguccaauguuagaugaggguguugaaccggaugauguagauuguuggugcaauacaacaucaacauggguaguauacggaacaugucaccauaagaaaggagaagcuagaagaagcagacgagcaguaacacuaccaagucacucaacaagaaaauuacaaaccagaagucaaacuugguuagaaagucgagaauauacaaaacaucuuauacggguagaaaauuggauauuuagaaauccuggauucgcacuugcagcggcagccauagccuggcuauugggcagcaguacaagccaaaaaguaauuuaucuuguaaugauauuauuaauagcuccagcauauagcauuagauguauaggaguaagcaacagagauuuuguagaaggaaugucaggaggaacauggguugauauaguauuagaacacggugguuguguaacaguaauggcacaagauaaaccuacaguagacauugaacuuguaaccacaacaguuaguaauauggcagaaguaagaucauacuguuaugaagcuaguauaucagauauggcaagugacucaagauguccaacacaaggagaagcauauuuagacaaacaaucagauacacaauacgugugcaaaagaacauugguagacagaggaugggggaauggauguggauuauucggaaaaggaucauuaguaaccugugcaaaauuugcauguaguaagaaaaugacagguaaaucaauacaaccugaaaaucuagaauauagaauaaugcuauccguacacggcagccaacacuccggaaugauaguaaaugacacuggacaugagacugaugaaaaucgagcaaaaguagaaauaacaccuaauagccccagagcagaagcaacauugggaggauuugguagcuuaggauuagacugcgaaccuagaacuggcuuagauuuuuccgacuuauauuauuuaacaaugaauaauaaacauugguuaguacauaaagagugguuucaugacauaccacuaccguggcacgcaggagcagauacaggaacuccacauuggaacaauaaagaagcccuaguagaauuuaaggacgcacaugcaaaaagacaaacaguaguaguuuuggggucacaagaaggagcaguacauacagcauuagcaggcgcacuagaagcugaaauggauggcgcaaaaggacgauugagcucaggucauuuaaaaugcagacuuaaaauggauaaauuaagacugaaaggggugucuuauucgcuauguacagcugcauuuacauucacaaaaauaccagccgaaacauuacacggaacagucacaguagaaguucaguaugcuggaacugacggcccauguaaaguuccagcacaaauggcaguagauaugcaaaccuuaacaccuguaggaagguuaauuacagcaaauccaguaauaacagaaucaacagaaaauaguaaaaugauguuagaauuagacccaccuuuuggagauaguuacauaguaauuggagucggagagaagaaaauuacacaucacuggcacagaagcggaagcacauuaggaaaagcauuuagcacaacguuaaaaggagcacaaagauuagcugcauuaggagauacagcaugggauuucggaucaaucggaggaguuuucaauaguauagggagagcaguacaccaaguauucggaggagcauucagaacacuauucggaggaaugaguuggauaacacaagguuuaaugggagcacuacuauuauggaugggcguaaacgcccgcgaccgaucuaucgcauuagcauucuuagcaaccggcggcguacuuguuuuccuagcaacaaacguacaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11529 - RNA, 2485 nt, Artificial Sequence
  ZIKV (isolate Z1106033) prME-short variant mRNA Design 2 opt
ggggcgcugccuacggagguggcagccaucuccuucucggcaucaagcuuaccaugggaagaaaacaaaauaaaaggggagguaaugaaggaucaauaaugugguuagcaaguuuagcuguaguaauagcaugugcaggagcaguaacaagaagagguagcgcauacuacauguauuuagacagaaacgaugcaggagaagcaauuuccuuccccacaacuuuaggaaugaauaaauguuauauacaaauaauggauuuaggacacacaugugaugcuaccaugucauaugaaugucccaugcuagaugaaggaguagaaccagacgacguugauuguugguguaauacaacaaguacuuggguuguauaugggacaugucaucauaagaaaggcgaagcucgaaggucaagacgagccguaacauugccgagucauucaacaagaaaauuacaaacgagaucacaaacauggcucgaaucaagagaauacacaaaacacuuaauaagaguugagaacuggauauucagaaauccugguuuugcauuagcagcagcugccauagcauggcuauuaggaaguagcacaucucaaaaaguuauauacuugguaaugauucuauuaauagcuccagcauauucuauaagauguauaggaguuaguaaccgagacuuuguagaaggaaugagcggaggaacguggguagacguaguauuagaacauggaggaugcguaacaguaauggcacaagauaaaccaacagucgauauagaauuaguaacaacaacaguaucaaauauggcggaaguaaggaguuauuguuaugaagcaucaauaagugacauggcaagugauaguagaugucccacacaaggugaagcguauuuagauaaacaaagugauacacaauauguuugcaaaaggacauuaguagauaggggauggggaaacgguuguggauuauuugguaaaggaagucugguaacaugugcaaaauucgcuugcucaaagaaaaugacaggaaaaucuauacaaccagaaaauuuagaauacagaauaauguuaagcguacauggaagucaacacucaggaaugauagucaaugauacaggucaugaaacagaugaaaacagagcaaaaguagaaauuacaccaaauucaccgagagcagaagcgacauuagguggauucgggaguuuaggccuagacugugagccccgaacaggucuagauuuuucagauuuguauuaccuaaccaugaauaauaaacacuggcugguacauaaagaaugguuccacgauauaccacuuccauggcaugcaggagcagacacaggaacaccacauuggaauaacaaagaagcauuaguggaguucaaagacgcucaugcuaaaaggcaaacuguuguuguuuuaggaagucaagaaggagcuguacacacggcacuagcgggugcauuagaagcagaaauggauggagcaaaagguagacuaucaucaggacacuuaaaaugccgguuaaaaauggauaaacuaagauuaaaaggagucaguuauucauuaugcacugcagcuuuuacauucacuaaaauuccggcagaaacacuacauggaacagucaccguagaaguacaauaugccggaacagauggacccuguaagguuccggcacaaauggcaguagauaugcaaaccuugaccccaguaggaagauuaauaacagcaaacccaguaauaacggaaaguacagaaaauucaaagaugaugcucgaauuggauccaccauuuggagauucauauauaguuauuggaguuggagaaaagaaaauuacacaccauuggcauagaaguggaucaacauuaggaaaagcauuuucgacaacauuaaaaggagcacaaaggcuagcagcauuaggagauacagcaugggauuuuggcaguauugguggaguguuuaauucgauaggcagagcaguucaucaaguauuuggaggagcauucagaacauuguucggaggaaugaguuggaucacccaaggauuaaugggagcauuacuacuauggaugggagucaaugcaagagauagaagcauagcauuggcuuuucuggcuacaggaggaguucuaguauuuuuagcaacaaacguacaugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11530 - RNA, 2473 nt, Artificial Sequence
  ZIKV (strain MR 766) prME-short variant mRNA Design 2 opt
ggggcgcugccuacggagguggcagccaucuccuucucggcaucaagcuuaccaugggacguaaacaaaauaaacgaggaggaaacgaagguucaauaauguggcucgcaagucuagcaguaguaauagcaugugcaggagcaauaacaagaaggggaucugcauacuacauguauuuagacagaucagacgcaggaaaagcaauaaguuuugcuacaacauuaggaguaaauaaaugucacguacaaauaauggaccuaggacacaugugugaugcuacaaugucauaugaauguccuaugcucgaugaaggaguagaaccugaugacguggauuguuggugcaacaccacaagcacauggguaguauacggaacaugucaucacaaaaaaggagaagccagaagaagcagaagggcaguuacauugccgagucauuccacaaggaaauuacaaacaagaucacagacuugguuagaaaguagagaauacacaaaacauuugauaaaagucgaaaauuggauuuuccgaaauccaggauuugcauuaguagcaguagcaauagcaugguuauugggaagcagcacaagucaaaaaguaauauaccuuguuaugauacuacuaauagcuccagcuuacucuauacgauguauugguguaagcaauagagauuuuguagaaggaaugucaggaggaacauggguagacgugguacuagaacauggaggcuguguaacgguaauggcacaagauaaaccgacaguagauauagaauuaguaacaacaacugugaguaauauggcagagguaagaaguuauugcuaugaagcaucuauaagcgacauggcaucagauucgagaugccccacacaaggagaagcuuauuuagacaaacaaucagacacacaauacgucuguaaacggacgcuagucgacagggguugggguaaugguugcggucuauuuggcaaaggaucauuaguaacaugugcuaaauuuacuuguucuaaaaaaaugacaggaaaauccauucaaccagaaaauuuagaauauagaauaaugcuaucaguacaugguagucaacauaguggaaugauaggauaugagacugaugaagauagagcuaaaguugaaguaacaccgaacaguccacgagcagaggcaacacuaggaggauuuggaucauuaggacucgauugugaaccaagaacaggauuagauuuuucagaucuauauuacuuaacaaugaauaauaaacauugguuaguacauaaagaaugguuucaugauauaccacuaccuuggcaugcgggagcagacacgggaacuccacacuggaauaacaaagaagcacuuguagaauucaaagacgcacaugcaaaacgacaaacagugguaguauuaggaucacaagagggugcaguacauacagcuuuagcaggagcacuagaagcagaaauggacggugcaaaagguagauuauucucuggucacuuaaaaugcagauuaaaaauggauaaauuaagauuaaaaggaguuaguuauucauuauguacagcggcauuuacauuuacuaaaguaccagcugaaacauuacacgguacagucacaguugaaguacaauaugcaggaacugauggcccuuguaaaauaccaguacagauggcaguagauaugcaaacauugacaccaguaggacgcuuaauuacagcaaauccaguuauuaccgaaucaacagagaauucaaaaaugauguuagaauuagauccucccuuuggagauagcuauauuguuauaggcguaggugauaaaaaaauaacacaucauuggcaucgaucaggaaguacuuuaggaaaagcauucucaacaacuuuaaaaggagcacaaagguuagcagcacuaggcgauacugcaugggacuucggaucuauaggagguguauuuaauagcaucggcagggcaguacaucaaguauuuggaggagcuuuuagaacacuauucggggguaugaguuggauaacacaaggacuaaugggcgcauuacuauuauggaugggaguaaaugcuagagaucguucaauagcacuagcauuuuuagcuacagggggaguauuaguauuuuuagcaacuaauguacacgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11531 - RNA, 2485 nt, Artificial Sequence
  ZIKV (strain NatalRGN) prME-short variant mRNA Design 2 opt
ggggcgcugccuacggagguggcagccaucuccuucucggcaucaagcuuaccaugggccggaaacaaaauaaaagagggggaaaugaaggaucgauaauguggcuagccucauuagcaguuguaauagcaugcgccggugcgguaacacgaagaggaagugcuuacuauauguaccuagaccgaaaugaugcgggagaagcuauuaguuuuccaacaacacugggaaugaauaaauguuacauacaaauaauggaccuaggacacaugugcgaugcuacaaugaguuaugaauguccaauguuagaugaggguguagaaccagaugacguagauuguugguguaauacaacaaguacauggguaguauauggaacaugucaucacaagaaaggcgaagcaagaagaucaagacgagcaguaacauuaccaucacauucuaccagaaaauuacaaacaaggagucaaacuuggcuagagucuagagaauauacgaaacaucuaauacgaguagaaaauuggauauuuagaaauccaggauucgcauuagcagcugcagcgauagcauggcuacucggauccucaacaucacaaaaaguaauuuacuuagugaugauacuauuaauagcaccagcauauagcauuagguguauaggaguaagcaauagagauuuuguagaaggaaugaguggaggaacaugggucgacguaguauuagaacauggcggauguguaacaguaauggcacaagauaaaccaacaguagauauagaauuaguaacuacaacaguuucaaauauggcagaaguacgaucuuacugcuaugaagcaaguauuucugauauggccucagacaguagaugccccacccaaggugaagccuaucuggauaaacaaucagauacccaguacgucuguaaaagaacccuaguagauagaggauggggaaauggauguggauuauucggaaaagggaguuuaguaacaugugcaaaauuugcaugcucaaagaaaaugacuggaaaaucaauacaaccugagaacuuagaguacagaauaauguuaaguguccauggaucacaacauagugguaugauugugaaugacacaggucaugaaacagaugaaaaucgagcaaaaguagaaauaacaccaaauucaccaagagcagaggcuacauuaggagguuuuggaucguuaggacuagacugcgaaccaagaacaggacuagacuuuagugaucuauacuaucuuacuaugaacaauaaacauuggcuaguucacaaagaaugguuucaugacaucccccuacccuggcaugcaggagcugauacaggaacaccacauuggaauaauaaagaagcguuaguugaauuuaaagaugcacacgcaaaacgacaaacaguggugguauuaggaucccaagagggagcuguacauacagcacuugcaggagcacuagaagcagaaauggauggagcaaaaggaagguuaagcaguggccauuuaaaauguagacuaaaaauggauaaauuaagauuaaaagguguaucauauagcuuauguacagcagcauucacuuuuacaaaaauacccgcagaaacccuucacggaacagucaccguggaaguacaauacgcaggaacugacggaccauguaaaguaccugcucaaauggcuguagauaugcaaacucuaaccccaguuggaagauuaauuacagcaaauccaguuauaacagagucaacagaaaauucaaaaaugaugcuagaauuagauccaccauuuggugauaguuacauagugauaggaguaggagaaaagaaaauaacgcaucauuggcauagaucgggaucaacacuuggaaaagcauuuaguacaacccuaaaaggagcacaaagauuagcagcauuaggggauacugcaugggacuucgguagcauaggagguguauucaauagcauaggcagagcaguacaccaaguauucggaggagcauucagaacauuauucggaggaaugucauggauaacacaaggauuaaugggagcauuauuauuguggaugggaguaaacgcaagagacagaagcauagcauuagcauuccuagcaacaggaggaguuuuaguuuuccuggcaacaaacguacaugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11532 - RNA, 2458 nt, Artificial Sequence
  ZIKV (strain ZikaSPH2015) prME-short variant mRNA Design 2 opt
ggggcgcugccuacggagguggcagccaucuccuucucggcaucaagcuuaccaugaaugaaggauccauaaugugguuagccaguuuagcuguaguaaucgccugcgcuggagcaguuacacggcgaggaucagcauauuauauguauuuagacagaaacgaugcuggagaagcaauaucauuuccaacaacacuaggaaugaauaaauguuauauacaaauaauggauuugggacauaugugugacgcaacaaugaguuaugaauguccaauguuagaugaaggagucgaaccagaugauguagacugcugguguaauacaacaucaacauggguuguuuauggaacaugucaccauaagaaaggagaggcaagaagaaguaggagagcaguaacucuuccaagucacucaacucgaaaacuacaaacacgaucacaaacaugguuagaaucuagagaauauacuaaacauuugauaagaguagaaaacuggauauucagaaaucccggauuugcacuagcagcagccgcaauagcaugguuacuaggaucaaguacuucacaaaaaguaauauauuugguuaugauucuguuaaucgcuccagcauauaguauaagauguauaggagucagcaacagagauuuugucgaagguaugucaggagguacauggguugacaucguacuagaacacggcgguuguguaacgguaauggcacaagauaaaccaacaguagauauagagcuaguaaccacaacaguaucaaauauggcugaagugaggucauauuguuaugaagcaucuauuagugauauggcaucagauagucgauguccuacacaaggagaagcauauuuagauaaacaaucagacacacaauacguuuguaaaagaacucuaguagacagaggauggggaaacggauguggacuauuuggaaaaggcagccuaguaacaugcgcaaaauuugcaugcucaaagaaaaugacuggaaaaucaauacaaccagaaaauuuagaauaucgcauaaugcuuagcguacaugggucacaacacucaggaaugauaguaaacgacacuggacaugaaacugacgaaaacagagcaaaaguggaaauaacaccuaauaguccaagagcagaagcuacucuaggaggauucggaagucuaggcuuagauugugaaccuagaacgggacuagacuucucugaucuauauuacuuaacaaugaauaacaaacacuggcuuguucauaaagaaugguuucacgauaucccauuaccauggcaugcaggagcagauacaggaacaccacauuggaauaacaaagaagcauuaguagaauuuaaggaugcacaugcuaaaagacaaacaguaguaguacuggguucacaagaaggagcaguccacaccgcauuagcaggagcuuuagaagcagaaauggauggagcaaaaggacgacucucaucuggacaucuuaaaugcagacuuaagauggauaaacuaaggcuaaaaggaguaaguuauucauuauguacagcugcauuuacauuuacaaaaauacccgcagaaacauuacauggaacagugacuguagaaguacaauaugcaggcacagaugguccguguaaggucccugcacaaauggcaguugauaugcaaacauuaacaccagucgguagacuaauaacagcaaaucccguaauaacugaaucaacugaaaauucaaaaaugauguuggaauuagauccacccuucggagacucauacauuguaauaggagucggugagaagaaaauaacucaccauuggcacagaaguggaagcacacuagguaaagcauuuucaacaacauuaaaaggcgcacaaaggcuagccgcacuuggugacaccgcgugggauuuuggcucaauagguggaguauuuaauaguauaggucgugcuguacaccaaguauuuggaggcgcauuucgaacucuauuugguggaauguccuggauaacucagggacuaaugggagcacuacuacucuggaugggaguuaaugcaagagauaggucaauagcuuuagcguuucuagcaacaggugguguacucguauuccuggcaacaaacguacaugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11533 - RNA, 2458 nt, Artificial Sequence
  ZIKV (isolate Z1106033) prME-short variant mRNA Design 2 opt
ggggcgcugccuacggagguggcagccaucuccuucucggcaucaagcuuaccaugaaugaagguaguauaaugugguuagcaaguuuagcaguaguaauugccugugcaggagcaguaacaaggagaggaagugcauauuauauguaucuggacagaaaugacgccggagaagcgauuaguuuuccaaccacgcuaggaaugaacaaauguuacauacagaucauggauuuaggacauacaugugacgcaacaaugucauacgaaugcccaaugcuagaugaaggaguagaaccugacgauguagacuguugguguaauacuacuucaaccuggguaguauauggaacaugucaccacaagaaaggagaagcaagaagaucaaggagagcagucaccuuaccaucacauagcacaagaaaauuacaaacaagaucucaaacuuggcuugagagcagagaauacacaaaacauuuaauaagaguagaaaauuggauauuuagaaauccaggauuugcuuuagcagccgcagcgauagcaugguuacuaggaagcucaacaucccaaaaaguuauauauuuaguaaugauauuauuaauugcuccugcauauucgauaagauguauuggaguaucaaauagagauuuugucgaaggaaugagcggagggacauggguagauguuguacuagaacacgguggaugcguuacaguaauggcacaagauaaaccaacagucgauauagaauuaguuacaaccacaguaaguaacauggcagaaguaagaucguauuguuaugaggccuccauuucagauauggcaucugauucacgaugcccaacacaaggagaagcauaucuugauaaacaaucagauacccaauauguuuguaaaagaacuuuaguugacagagguuggggaaauggcuguggucuauucggcaaaggaagccuaguaacaugugccaaauucgcauguucgaagaaaaugacuggaaaaucuauucaaccugaaaacuuagaauauagaauuauguuaucagugcaugguucacaacacaguggaaugauaguaaaugacacaggacaugaaacagaugaaaacagggcaaaaguagaaauaacaccaaauucacccagagcugaagcuacauuagguggauuuggaagucucggacuagauugcgaaccaagaacaggauuagauuuuagugaucuauauuaccuaacaaugaacaacaaacauuggcuuguucacaaagaaugguuccacgauauuccccuacccuggcaugcaggagcagacacagguacaccucauuggaauaauaaagaagcauuaguagaauuuaaagaugcacaugcaaaaagacaaacaguaguaguacuaggaucucaagaaggugcaguacauacugcccuagcaggagcccucgaagcggaaauggauggagcaaaaggaagauuaucaucuggccaucuaaaaugcagauuaaaaauggacaaacuaagacuuaaaggaguaaguuauagucucuguacagcagcauuuacauuuacaaaaauuccagcagaaacuuuacaugguacuguaacaguagagguucaauaugcaggaacagauggaccauguaaaguccccgcacaaauggcgguggacaugcaaacacuaacuccaguaggaagacuaauaacagcaaauccaguaauaacagaaucaaccgaaaacucgaaaaugauguuagaauuagacccaccuuuuggugauagcuauauuguaauagguguaggagagaaaaagauaacacaccauuggcauagaagugggucaacacuaggaaaagcauuuagcacaacacuaaaaggcgcacaaagauuggcagcauuaggugacacagcuugggacuucggcagcauaggaggaguauuuaauucaauuggcagagcaguacaccaaguauuugguggagcuuuuagaacuuuauucgguggaaugaguuggauuacacaagguuuaaugggagcuuuacuacuauggauggguguaaaugcaagagauaggagcauagcauuagcauuucuagcaacagguggagugcuaguauucuuagcaacgaacguacaugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11534 - RNA, 2446 nt, Artificial Sequence
  ZIKV (strain MR 766) prME-short variant mRNA Design 2 opt
ggggcgcugccuacggagguggcagccaucuccuucucggcaucaagcuuaccaugaaugaaggcucaauaauguggcuagcaucacuagcaguaguaauagcaugcgcuggagcuauaacuagaagaggaucagcuuacuacauguauuuagauagaagugacgcagguaaagcaauaucauuugcaacaacacuaggagucaacaaaugucauguacaaauaauggauuugggacacaugugugaugcaacaaugagcuacgaaugcccaauguuggacgaaggaguagaaccugaugauguugacuguugguguaauacaacaagcacuugggucguauaugguacaugccaucauaagaaaggagaagcaagacgaucuagacgagcaguaacacuuccgagucauucuacaagaaaauuacaaacgagaagccaaacuuggcuagaaucuagagaauauacaaaacaucuaauaaaaguagaaaauuggauauuuagaaauccaggauucgcauuaguagcaguggcaauugcauggcuauugggaagcaguacgagccaaaaaguaauauaucuaguaaugauauuacuaauagccccugcuuacagcauaagaugcauaggaguaucuaauagagauuuuguugaaggaaugucuggagguacuugggucgacguaguguuagaacauggaggauguguaacaguaauggcacaagacaaaccaacaguagacauagaauuagucacuacaacuguaucgaauauggcugagguaagaagcuauuguuaugaagcaagcauaagugauauggcauccgacaguagauguccaacucaaggagaagccuaucuagauaaacaaagugauacgcaauauguauguaaaagaacccuaguagacagaggguggggaaauggauguggauuauuuggaaaaggaagucuuguaacaugcgcaaaauucacauguucaaagaaaaugaccggaaaaagcauucaaccugaaaaucuagaguaucgaauaauguuaucuguacauggaucacaacauucaggaaugauaggauacgaaacggacgaggauagagcaaaaguagaaguaacaccaaauaguccaagggcagaagcuacauugggaggauuuggcagcuuaggauuagauugcgaaccacgcacaggauuagauuuuagcgauuuauauuauuuaacaaugaauaauaaacauuggcuaguacauaaagaaugguuucaugauauaccucuaccauggcacgcuggagcagauacaggaacaccacauuggaacaacaaagaggcgcuuguagaguucaaagacgcacacgcgaaaagacaaacaguaguuguuuuaggaagucaagaaggagcuguacacacagcauuagcaggagcuuuagaagcagaaauggacggagcaaaaggaagauuguuuaguggucaucuaaaauguagacuaaaaauggacaaauuaagauuaaaaggugucaguuauucauuauguacagcugcauucacauuuacaaaaguuccugcggaaacuuuacauggaacugucacugucgaaguacaauacgcgggaaccgauggacccugcaaaauaccuguacaaauggcuguagacaugcaaacauuaaccccaguaggaagauuaauaacagcaaauccaguaauaacagaaaguaccgaaaauucaaaaaugauguuagaacucgacccacccuuuggagauucauacauagucauaggaguaggagauaagaaaauaacacaucauuggcaucgaaguggcucaacacuagggaaagcauuuucaacuacgcuuaaaggugcacaaagauuagcagcuuuaggugacacagcaugggauuuuggaagcauaggaggaguauuuaacucaauagguagggcuguacaucaaguauuuggaggugcguuucgaacauuauucggaggaaugaguuggauaacucaaggauugaugggggcuuuacuguuauggauggguguaaaugcuagagauagaaguauugcauuggcauuuuuagcaacuggaggaguguuaguguuuuuagcaacaaauguacaugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11535 - RNA, 2458 nt, Artificial Sequence
  ZIKV (strain NatalRGN) prME-short variant mRNA Design 2 opt
ggggcgcugccuacggagguggcagccaucuccuucucggcaucaagcuuaccaugaaugaaggaaguaucaugugguuagcaaguuuagcaguaguaauugcaugcgcaggggcaguuaccagaagaggcagcgcuuacuauauguacuuagacagaaacgacgcaggagaagcgaucucauucccaacaacauuaggaaugaauaaauguuauauucaaauuauggacuuaggacacaugugugaugcuaccaugucauaugagugcccaaugcuugaugaaggaguggagccagacgacguugauuguuggugcaauacaaccucaacuuggguuguauauggaacaugucaucauaaaaagggagaagcaagaagaucaagaagagcaguaacacuaccuucacauucaacaagaaaauuacaaacacguucgcaaacaugguuagaaucaagagaauauacaaaacaucugauaagaguggaaaauuggauauuccgaaauccaggcuucgcauuagcagcugcggcaauugcaugguuacugggaucaucuacaagucaaaaaguaauuuacuuaguuaugauacuauuaauagcaccagcauacucaauaagguguauaggaguaagcaauagagauuucguagaaggaaugucuggcgguacguggguggacguaguacuggaacacggaggauguguuacaguaauggcacaagacaaaccgacuguugauauugaauuaguuacaacuacaguuucaaauauggcagaaguaagaucauauugcuaugaagcaucaauaucugauauggcuucagauucaagaugucccacucaaggagaagcauaucuugauaaacaaucagacacccaauacguaugcaaacgaacauuaguagauagaggauggggaaacggaugcggacuuuuuggaaaaggaagucuagucacaugugcaaaauucgcaugcaguaaaaaaaugacugguaaaucaauucaaccagaaaauuuagaauacagaauaaugcucaguguacauggaagccaacauucaggaaugauaguaaaugauacaggacacgaaacagacgaaaauagagcuaaaguugaaauaacgccaaacucacccagggcggaagcaacucuaggugguuuuggaucucuaggauuagauugcgaaccuagaacaggauuagauuucucagacuuauauuacuuaacaaugaauaauaaacauugguuaguucauaaagaaugguuucacgacauuccuuuaccauggcaugcuggagcugauacaggaacaccacauuggaauaauaaagaggcauuaguggaauucaaagacgcacaugcgaaaagacaaacaguuguaguauugggaagucaagaaggagccguccauacagcacuagcgggggccuuagaagcggaaauggauggagcaaaagguagauuaucaaguggacaucuaaaaugucgauuaaaaauggauaaauuaagguuaaaaggagucaguuacagucuauguacagcugcauucacauucacaaaaauaccagcagaaacauuacauggaacaguuacugucgaaguucaauaugcaggaacugacggaccauguaaaguaccagcucaaauggccguagauaugcaaacacuaacaccaguaggaagacuaauaacagcaaacccaguaauaacagaaucuacggaaaauucaaaaaugauguuagaguuagauccaccauucggagacagcuacauaguaauaggaguaggagaaaaaaaaauaacucaucauuggcaucgaaguggaucaacauuaggaaaagcguuuucaacaacauuaaaaggagcucaaagacuagcagcacucggagacacugcaugggauuuuggaaguauaggagggguauuuaauagcaucggaagagcaguacaucaaguauucgguggagcuuucagaacuuuauuugguggaaugaguuggauuacacaaggacugaugggcgcacuacuauuauggaugggagugaaugcaagagauagaucaauagcauuggcauuccuagcaacugguggaguacucguauuuuuggcaacaaauguacacgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11536 - RNA, 2485 nt, Artificial Sequence
  ZIKV (strain ZikaSPH2015) ME variant mRNA Design 2 opt
ggggcgcugccuacggagguggcagccaucuccuucucggcaucaagcuuaccaugggaagaaaacaaaauaaaagaggugggaaugaaggaucaauaauguggcuagcuucacuagccguaguuauagcuugugcaggagcagugacaagaagaggaagugcauauuacauguacuuggacagaaacgaugcuggugaagccauaaguuuuccaaccacguuagguaugaauaaauguuacauucaaauaauggauuugggacauaugugugaugcuacaaugaguuaugaauguccaauguuagacgaagguguugaaccagacgauguagauugcuggugcaauacaacaaguacauggguuguauacgggacaugccaccacaagaaaggcgaagcaaggagaaguaggagagcggucacauuaccgagucauucuaccagaaaauuacaaacgagaagucaaacaugguuagaaagcagagaauauacaaaacauuuaauuagaguugaaaauuggauauuuagaaauccaggauucgcguuggcggcagcagcaauagcaugguuacucggaucaagcacaagucaaaaaguaauauaccuaguaaugauacuguuaauagcgccagcauauucaauacgauguauuggcgugagcaacagagacuuuguagaaggaaugucuggugguacauggguagauauagugcuagagcauggaggaugcgugacaguuauggcacaagauaaaccaacuguagacauagaauuaguaacaacuacaguuucaaauauggcagaaguuagaaguuauuguuaugaagcaucaauaagugacauggcaucagauuccaggugcccuacacaaggcgaagcauauuuagauaaacagucagauacacaauaugucuguaaaagaacgcuaguagauagaggauggggaaauggaugcggacuuuuugguaaaggaucauuaguaacaugcgcaaaauuugcauguucaaagaaaaugacaggaaaaucaauacaaccagaaaauuuagaauaccguauaauguuauccguacaugguagucaacauagugguaugauaguaaaugauacaggacacgaaacagaugaaaauagggcuaaaguugaaauaacaccgaacuccccacgagccgaagcuacauuaggaggauucgguagccuaggauuagauugugaaccgagaacagguuuagauuuuucagaucuauauuaucuuacaaugaacaacaaacauuggcuaguucacaaagaaugguuucaugacauaccacuuccauggcaugcaggagcagacacaggcacaccacauuggaauaauaaagaagcucuaguagaauuuaaagacgcucaugcaaagagacaaacaguuguaguccuaggaagucaagaaggugcaguucacacagcacuagcaggagcucuagaagcugaaauggauggagcgaaagguagacuaucaagcggacaccuuaaauguagguuaaaaauggauaaauuaagauugaagggaguaaguuauagcuuaugcaccgcugcauuuacauucaccaaaauaccggcagaaacuuuacauggcacgguuacaguagaaguccaauaugcaggaacggauggaccaugcaaaguacccgcacaaauggcaguagauaugcaaacauuaacuccuguaggccgacuuauaacggcaaauccuguuauaacagaaaguacugaaaauucaaaaaugauguuagaacuagacccuccauucggagauaguuauauaguaauuggaguaggagaaaagaaaauaacgcaucauuggcauagaagcggaucaacuauagguaaagcauuugaagcaacaguacgaggagcaaaaagaauggcaguacuaggagauacggcaugggauuuugguucaguaggaggagcauuaaauucauuaggaaaaggaauacaccaaauauuuggagcagcauuuaaaaguuuauucggaggaaugucaugguucagucaaauacuaauaggaacucuacuaauguggcuagguuuaaauaccaaaaaugguucaauaucauuaauguguuuagcuuuaggggguguauuaauauuucuaucuacagcuguauccgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11537 - RNA, 2485 nt, Artificial Sequence
  ZIKV (isolate Z1106033) ME variant mRNA Design 2 opt
ggggcgcugccuacggagguggcagccaucuccuucucggcaucaagcuuaccauggggagaaaacaaaauaaaagaggaggaaacgaaggaaguauuaugugguuagcuucauuagcagucguaauagcuugugcuggagcaguaacuagaagaggcucagccuacuauauguauuuggaccgaaaugaugcuggugaagcaaucucuuucccaacuacuuuagggaugaacaaauguuauauacaaauaauggaucuuggacauacaugugaugcgacaaugucauaugaauguccaaugcuagaugaaggaguggaaccugaugacguagauuguugguguaauacuacaucaacauggguagucuaugguacaugucaccauaagaaaggagaagcacgaaggucacgcagagcaguaacauuaccaucacacucaacaagaaaauuacagacaagaagccaaacauggcuagaaaguagagaauauacaaaacauuuaauaagaguagaaaacuggauuuuuagaaacccaggauuugcauuagcagcagcagcaauagcauggcuauuagguucaucaaccagucaaaaagugauauaucugguaaugauauuauuaauagcaccagcauauucaauaagaugcauuggaguaucaaauagagauuuuguugaaggcauguccggaggaacauggguagacguaguccuagaacauggagguugcguaacagucauggcucaagauaaaccuaccgucgacauagaauuaguaacuacaacaguaucaaauauggcugaaguacgaagcuauugcuacgaagcaaguauuucagauauggcaucagacaguagaugcccaacucaaggugaagcauauuuagacaaacaaagugauacacaauauguauguaaaagaacucucguagaucggggauggggaaauggaugcggacuuuuuggcaaaggcucacuugugacuugugcaaaauuugcguguaguaagaaaaugacaggaaaaucaauacaaccggaaaauuuagaauaucgaaucauguugucaguacacggaucacaacauagcggcaugauagucaaugauacgggacaugaaacugaugaaaauagagcuaaaguagaaauaacaccaaauucaccaagagcagaggcgacauuaggaggauuuggaucacuaggacuagauugugaaccaaggacaggauuagacuuuagugaccuauauuauuuaacuaugaacaauaaacauuggcuaguacauaaagaaugguuccacgauauaccuuuaccauggcaugcaggagcagauacgggaacaccccauuggaauaauaaagaagcacucguagaguucaaagaugcacacgcaaaaagacaaacaguaguaguauuaggaagucaagaaggugcaguacauacugcauuagcaggagcauuggaagcagaaauggacggagcaaaaggucguuugucaucaggacauuuaaaguguagauuaaaaauggauaaauuaagacuuaaaggagucaguuauucguuauguacagcugcauuuacauucacaaaaauaccagcugaaacacugcacggaacaguaacgguagaaguacaauacgcaggaacggacggaccguguaaaguuccugcacagauggcaguagauaugcagacacuuacuccaguagguagguuaauaacugcaaauccagucaucacagaaucuacagaaaauaguaaaaugauguuagaauuagaucccccauuuggagauucauauauaguaauagggguuggcgaaaagaaaauaacacaucauuggcauagaucaggaucaaccauaggaaaagcauuugaagcaacaguaagaggugcaaaaagaauggcagugcuaggcgacacagcaugggauuuuggaucaguaggaggagcacuaaacagccuaggaaaagguauacaucaaauauuuggagcugccuuuaaaaguuuauucggaggaaugucuugguuuagucaaaucuugauaggaacucuauuaaugugguuaggauugaaugcgaaaaauggaucaauuucacuaauguguuuagcauuaggagggguuuuaauauuuuuaaguacagcagugagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11538 - RNA, 2473 nt, Artificial Sequence
  ZIKV (strain MR 766) ME variant mRNA Design 2 opt
ggggcgcugccuacggagguggcagccaucuccuucucggcaucaagcuuaccaugggacgaaaacaaaacaaaagaggagggaaugaaggcucgauaaugugguuagcaucuuuagcaguagucauugcaugugcuggagcaauuacaagaagagguucagcuuauuacauguaccucgauagaagcgacgcagggaaagcaauuucauucgcgacaacauuaggaguaaauaaaugucauguucaaaucauggacuuaggucacaugugcgacgcaacaaugagcuacgaauguccaauguuggacgaaggcguggaaccagaugauguagauuguugguguaauacuacaucaacaugggugguauauggcacuugccaucauaagaaaggagaagcaaggagaucaaggagagcgguaacccuaccaagucauaguacuagaaaauuacaaacuagaagccaaacauggcuugaaaguagagaauacacaaaacauuuaauaaaaguugaaaauuggauauuuagaaauccaggauuugcauuaguagcaguagcaauugcuugguuauuagguagcagcacaagccaaaaaguaauauaccuaguaaugauauuauuaauagcaccagcguacaguaucagauguauaggaguaagcaauagggacuuuguagaaggaaugucaggaggaacguggguagauguaguacuagaacaugguggauguguaacaguaauggcacaagauaaaccaacaguagacauagaacuuguuacaacuacaguaaguaacauggcagaaguaagaagcuacuguuacgaagcgucuauaucagauauggcaucagauucaagauguccaacacaaggagaagcauacuuagauaaacaaucggacacucaauauguaugcaaaagaacccuaguagauagaggauggggaaauggaugcgggcuauucggaaaaggaucauuaguuacaugugcaaaauuuacauguaguaagaaaaugacaggaaaaucaauacaaccagaaaacuuagaauauagaauaauguuaaguguucauggaucacaacauuccgggaugauuggcuaugagacagaugaagacagggcaaagguagaaguuacaccaaauucaccccgagcagaagcuacuuuaggaggauuugguagccugggauuagacugugaaccuagaacgggauuggauuuuagugauuuauauuaucuaacaaugaauaauaaacauugguuaguccauaaagaaugguuucacgacauaccauuaccauggcacgcaggggcugacacaggaaccccacauuggaauaauaaagaagcauuaguugaauuuaaagacgcgcaugcaaaaagacaaacaguaguaguguuaggaagccaagaaggagcagugcauaccgcucuagcgggagcacuagaagcagaaauggauggagcaaaaggaagguuauuuucaggacaucuaaaauguagacuaaaaauggauaagcuaaggcuuaaggggguaaguuauaguuuauguacagcagcuuucacauuuaccaaaguaccagcggaaacguuacauggaacgguaacaguagaaguacaauaugcaggaacagauggcccguguaaaauaccgguucaaauggcaguagacaugcaaacauugacacccguugguagauuaauaacagcaaauccaguaauaaccgaaucuacagaaaacucaaagaugaugcuugagcuagauccaccauuuggagacagcuauauuguaauagguguaggggauaagaaaauuacacaucauuggcaucgaaguggaucgacuauagguaaagcauuugaagcuacaguaagaggugcaaaaagaauggcaguuuuaggagauacagcaugggacuuuggaaguguuggggguguuuuuaauucacuagguaaagggauacaucaaauauuuggagcugcauucaaaucauuauuugguggaaugucaugguuuucacagauacugauaggaacacuauuaguaugguuaggguuaaauaccaaaaaugguucaauaaguuugacaugucuagcauugggaggagucaugauauuucuuaguacagcuguaagcgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11539 - RNA, 2485 nt, Artificial Sequence
  ZIKV (strain NatalRGN) ME variant mRNA Design 2 opt
ggggcgcugccuacggagguggcagccaucuccuucucggcaucaagcuuaccaugggcaggaaacaaaauaaaagaggaggcaaugaaggaaguauuaugugguuagcaucauuagcggucguuauagcaugugcaggcgcaguaacaagacguggaagugcauauuacauguauuuggacagaaaugaugcaggagaagcaauaagcuuccccacaacgcuaggaaugaauaaauguuauauacaaauaauggauuuaggacacaugugugacgcaacaaugucuuaugaauguccaauguuggaugaaggaguagaaccagaugauguagauugcugguguaauacuacaaguacauggguaguuuauggaacaugccaucauaaaaaaggcgaagcaagacgaagcagaagagcggucacacuaccuucacauucaacccgaaaauuacagacaagaagccagacauggcuugaaucaagggaauauacaaaacacuuaaucagaguggaaaacuggauauuuagaaauccaggauuugccuuggccgcagcagcaaucgcauggcuacuuggaucaaguacuagucaaaaagucauauaucucguaaugauacuuuuaauagcaccagcuuauaguauaagauguauaggagucucaaauagagacuuuguagaaggaaugucaggaggaacauggguagacguaguauuagaacaugguggauguguaacaguaauggcucaagacaaaccaacaguagauaucgaauuaguaacuacaacugugagcaacauggcagaaguuagaucauauugcuaugaagcaucuauaucugacauggcuucagauucccgauguccaacacaaggagaggcuuauuuagauaaacaaucugacacacaauauguauguaaaaggacuuuaguagauagaggauggggaaaugguugcgggcuauuuggaaaaggcucguuaguaacaugugccaaauucgccugcaguaaaaaaaugacaggaaaaucaauacaaccugaaaauuuagaauauagaauaauguugucaguacauggaucucaacauucggggaugauaguaaacgauacaggacacgaaacagacgaaaauagagcaaaaguugagauaacaccaaauucaccucgagcagaagcaacacuggggggguuuggaagucucggauuggacugugaaccaagaaccggacuagauuuuucagauuuauauuauuugacaaugaacaauaaacacugguuaguacauaaagaaugguuccaugauauaccacuacccuggcaugcaggagcagauacagguaccccacacuggaauaauaaagaagcacuaguagaauuuaaagaugcacacgcaaaaagacaaacaguaguaguauuaggcucacaagaaggagcaguccacacugcacucgcaggugcgcuagaagcugaaauggauggagcaaaaggcagauuaagcaguggacacuuaaaauguagacucaaaauggauaaauuaagacuaaaaggcguaaguuauagucuauguacagcagcauucacauucacaaaaaucccagcagaaacacuacauggaacagucacaguagaaguacaauaugcuggaacagauggaccauguaaaguuccagcacaaauggcaguugacaugcagacacuaacaccaguaggacgacuaaucacagcaaauccagucauaacugagucaacagaaaauaguaaaaugauguuagaauuagauccuccauuuggugauucauauauaguaauuggaguuggagaaaaaaaaauaacgcaucauuggcacagaaguggaucgacaauaggaaaagccuuugaagcaacgguaagaggggcuaagaggauggcugugcuaggagauaccgccugggauuucgguuccguaggaggagcacuuaacagcuuagguaaaggaauucaucaaauuuuuggugcugccuucaaaucauuguuuggaggaaugucaugguucucacagauauuaauagguacguuguuaauguggcuuggauuaaacacaaaaaaugguucuauaagcuuaaugugcuuagcauuaggaggaguauuaauauuucucucaacagccguuagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11540 - RNA, 2458 nt, Artificial Sequence
  ZIKV (strain ZikaSPH2015) ME variant mRNA Design 2 opt
ggggcgcugccuacggagguggcagccaucuccuucucggcaucaagcuuaccaugaaugaagguucaauaaugugguuagcaucauuagcaguugugauagcaugcgcaggcgcagucacaaggagaggcucugcuuauuacauguauuuagaucgaaaugaugcaggggaggcaauaaguuuuccaaccacacuuggaaugaacaaauguuauauacaaauaauggauuuaggacauaugugcgaugcaacuaugucauacgaauguccaauguuagaugaaggagucgaaccagaugacguggauugcugguguaauacaacgagcacguggguaguauauggaacuugucaccauaaaaaaggagaagcuagacgaagcagaagagcaguaacauuaccaagucauagcacacguaaacuccaaacacgaucacaaaccugguuagagagcagagaauauacuaaacacuuaauaaggguagaaaauuggauuuuuagaaauccuggauucgcauuagcggccgcugcaauagcaugguuauugggaaguucgacaagccaaaaagucauauauuuaguaaugauuuuauuaauagccccagcauauucaauaagauguauaggcguaucaaauagagauuuuguagaagggaugaguggaggaacauggguagauauaguucuagaacauggaggaugcguaacagucauggcucaagauaaaccuacaguugacauagaacuaguaacaacaacaguaucaaauauggcagaaguaagaagcuacuguuaugaagcuucaaucucggacauggcaucagauucaagauguccaacgcaaggagaagcuuauuuggacaaacaaagcgacacccaauaugucuguaaaagaacauuaguggauaggggaugggguaauggauguggccuauuuggaaaaggaagccuaguaacaugugcaaaauuugcaugcaguaaaaaaaugacuggaaaaucaauucaaccagaaaaccucgaauauaggauaauguuaaguguacauggaagucaacacaguggaaugauaguuaaugauacaggccaugaaacagacgaaaacagagccaaaguagaaauaacuccaaauucaccacgagcggaagcgacacuaggaggauuugggucauuaggauuagauugcgaaccaaggacaggauuagauuucagugauuuauauuauuuaacaaugaacaauaaacauugguuaguacacaaagaaugguuucacgacauaccccucccauggcaugcaggagccgauacagggacuccucauuggaacaauaaagaagcguuaguagaauuuaaagaugcucacgcuaaaagacaaacaguuguaguacuaggaucgcaggaaggagcagugcauacagcauuagcaggugcacuagaagcagaaauggauggcgcaaaaggaagacuaaguucaggacauuuaaaauguagauuaaaaauggauaaauuaagauuaaaaggaguuucuuauagucuaugcacugcagcuuuuacauuuacaaaaauaccggcagaaacgcuacaugggacaguuaccguagaaguucaauacgcaggaaccgacggcccaugcaaaguaccagcacaaauggcuguugauaugcaaacauuaacaccgguuggaagacucauaacagcuaauccaguaauaacagaaucaacagaaaacucaaaaaugauguuagaauuagauccuccauucggagacaguuacauaguaauaggugugggagaaaaaaaaauaacccaucauuggcacagaaguggaaguacaauaggaaaagcauucgaagcuacuguacgaggcgcgaaaaggauggcgguauuaggagauacagcaugggacuuuggaucgguaggaggagcauuaaauucauuagguaaaggaauacaucaaauauuuggagcugcauuuaaaaguuuauuugguggaaugagcugguuuagucaaauauuaauaggaacauuauuaaugugguuagggcuaaauaccaaaaauggaucaauaagucuaaugugucuagcauuagguggugugcuuauauuuuuaaguacagcagucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11541 - RNA, 2458 nt, Artificial Sequence
  ZIKV (isolate Z1106033) ME variant mRNA Design 2 opt
ggggcgcugccuacggagguggcagccaucuccuucucggcaucaagcuuaccaugaacgaaggaagcauaaugugguuggcaucauuagcaguagucauagcaugugcaggagcgguaacaagaaggggaagugcuuauuauauguauuuagauagaaaugaugcaggagaagcaauaucauuuccuacaacacuaggcaugaacaaaugcuauauacaaauaauggauuuaggacauacaugugaugcaaccaugagcuacgaaugucccauguuagacgaaggaguagaaccagaugauguagauugcugguguaacacuaccucaacauggguaguauacggaacaugucaucauaagaaaggagaagcaagaaggagccguagagcaguaacauuaccaagucauagcacaagaaaacuacaaacacguagccagacauggcuggaaucuagagaauauacaaaacauuuaauaagaguugaaaauuggauauuuagaaauccuggauuugcauuggcugcggcugcaauagccugguuacuaggaucaucaacaucucaaaaaguuaucuauuuaguaaugauacuacuaauagcaccagcuuauucaauacgaugcauaggaguuucaaacagagacuucguugaaggcauguccgguggcacauggguagauguaguacuagaacacggaggaugcguaacaguaauggcacaagauaaaccaacuguagauaucgaauugguaacaaccacagugucaaauauggcugagguaagaagcuacuguuaugaagcaucaauuucagauauggcaagugacucacguuguccgacacaaggugaagcauaucuagauaaacaaucagauacacaauauguuuguaaacgaacauuaguagaccgagguuggggaaaugguugcggacuauuuggaaaagguucacuggucacaugcgcgaaauuugcaugcucaaagaaaaugacaggaaaaaguauacaaccugaaaaucuggaauauagaauuauguuaucaguucauggcucucaacacucaggaaugauaguaaacgauacuggucaugaaacugaugaaaauagagcuaaaguugaaauaacaccaaacaguccgcgagcggaagcaacauuaggcggauuuggaagucuuggacuagacugugaaccgagaacaggauuagacuuuagugauuuauacuaucuaacaaugaacaauaaacauugguuaguacacaaagaaugguuucacgauaucccuuuaccauggcacgcaggagcugacacaggaacgccucauuggaauaacaaagaagcauuaguagaauuuaaagacgcgcaugcaaaacgacaaacaguaguaguacuagggucacaagaaggagcaguacauacugcauuagcaggagcauuagaagcagaaauggacggagccaaagguagauuaagcagcggacaucuaaaaugcagacuaaagauggauaaauuaaggcuaaaaggaguaucuuacagccuguguacagcugcauucacauuuacuaaaauuccagcagaaacauuacauggaacaguuaccguagaagugcaauaugcaggaacagauggcccauguaaaguaccagcucaaauggcuguugauaugcaaaccuuaacgcccguuggacgacuaauaacugcaaaucccguaauaacagaaaguacagaaaacuccaaaaugaugcuugaauuagauccaccauuuggagauucuuauauuguaauagguguaggugaaaagaaaauuacacaucacuggcacagaaguggaucaacaauaggaaaagcauuugaagcaacaguccgaggugcaaaaagaauggcaguacuaggagauaccgcuugggauuuugguucaguagguggagccuuaaacaguuuaggaaaaggaauacaccaaauauuuggagcagcauuuaaaucauuauucggaggaaugaguugguuuagccaaauauugauugguacgcuguuaauguggcuaggacuaaaugcaaagaauggaaguauaucauuaaugugcuuagcccuuggaggaguauuaauuuuucucaguacagcagucucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11542 - RNA, 2446 nt, Artificial Sequence
  ZIKV (strain MR 766) ME variant mRNA Design 2 opt
ggggcgcugccuacggagguggcagccaucuccuucucggcaucaagcuuaccaugaaugaagguagcauaaugugguuagcaaguuuagcaguaguaauugcuugcgccggagcaaucacgagacgaggaucagcauacuauauguacuuagauagaagcgaugcaggaaaagcuauaagcuuugcuacaacauuaggaguaaauaagugucaugugcaaauaauggacuugggacauaugugugaugcaaccaugucuuaugaauguccaauguuagaugaaggaguagaaccugacgauguagauugcugguguaauacaacaucaacauggguuguauacggaacgugccaccauaaaaaaggagaagcaaggagaucaagaagagccguaacacuaccaagucacucaacacgaaaacuacaaacaagaagucaaacaugguuagaaagcagagaauauacaaaacauuuaauaaaaguagaaaauuggauauucaggaauccagguuuugcuuuaguugcaguagcuauagcuuggcuauuaggaagcagcacgucacaaaaaguuauuuaucuaguaaugauacuacugauagcaccagcguacucaauaagaugcauuggaguuucaaauagagauuuuguagaaggaaugagcggaggaacuuggguagacguaguucuagaacaugggggaugcguaacaguuauggcacaagacaaaccaacaguagauaucgaacuaguaacaacuacaguaucaaauauggcagaaguacgaaguuauugcuacgaagcaucaaucucggauauggcaagugauagucguuguccgacacaaggcgaagcauacuuagauaaacaaagugauacgcaauaugucuguaaaagaacauuaguagacagaggguggggaaauggaugcggacuauuugguaaaggauccuuaguaacaugcgcuaaauucacuugcucuaaaaaaaugacagggaaaaguauacaaccugaaaaccuggaauaucgaauaauguuaucaguucauggaucacaacauucaggaaugauaggauacgaaacggaugaagauagagcaaaaguagaaguaaccccaaauaguccuagagcugaagcuacacuaggagguuuuggcucacuaggauuagauugugagcccagaacaggacucgauuucagugaucuauauuauuuaacaaugaauaauaagcauuggcuaguacacaaagaaugguuucaugacauaccucugccauggcaugcaggagcagauacaggaacaccccacuggaauaauaaagaagcuuuagucgaauucaaagacgcucacgcaaaaagacagacaguugucguuuuaggaagucaagaaggagcaguacauacagcucuagcuggugcauuagaagcagaaauggauggugcaaaaggaagauuauuuagcggacaucuaaaaugucgauuaaaaauggauaaauuaagauuaaaagggguaucauauagucuauguacagcagcauucacauuuacgaaaguaccggcagagacauuacauggaacaguaacaguugagguccaauacgcaggaacagacggacccuguaaaauaccugugcaaauggccguagacaugcaaacguuaacuccaguaggaagacuaaucaccgcaaauccaguaauaacugaaucaacugaaaauaguaaaaugaugcuugaauuagauccaccauucggagauucauauauaguaauuggaguuggugauaaaaaaaucacacaucauuggcauagaucagggucaacaauaggaaaagcauucgaggcgacaguaagaggagcuaaaagaauggcuguucuaggagauacagcaugggauuucggcagcguaggcgguguauucaacagcuuaggaaaagggauacaucaaauauuuggcgcagcauuuaaaagucuauuuggugguaugucgugguuuucacaaauacuaauaggaacccuauuaguuugguuaggacuaaauacaaaaaacggaucaauaucucuaacaugcuuagcauuaggaggagugaugauuuuucuaagcacagcaguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11543 - RNA, 2458 nt, Artificial Sequence
  ZIKV (strain NatalRGN) ME variant mRNA Design 2 opt
ggggcgcugccuacggagguggcagccaucuccuucucggcaucaagcuuaccaugaacgaaggaaguauaaugugguuagcaaguuuagcagucguaauagcaugugcgggagcaguaacuagaaggggaagugcauauuauauguaccuagauaggaaugacgcuggugaagcaauaucauuuccaacuacuuuagggaugaauaaaugcuauauacaaauaauggauuuaggucauaugugugaugcaacaaugaguuaugaauguccaauguuggacgaaggaguagaaccagaugacgucgauuguugguguaauacaacaagcacauggguaguuuacggaacgugucaccacaagaaaggagaggcaagacgaaguagacgagcagucacauuaccaagccacaguacaagaaaacuucaaacuagaagucaaaccuggcuagaaucaagagaguacacaaaacaccuaauaagaguagaaaauuggauauuuagaaauccaggauuugcucuagcagcagcagcaauagcaugguuacuaggaagcaguacaagucaaaaaguuauauaucuaguaaugaucuuauuaauagcucccgcguacucgauaagauguauuggagugaguaauagagauuuuguagaaggcaugucaggcgguaccuggguagauguagugcuagaacauggaggaugcguaacaguaauggcacaagauaagccaacaguagauauagagcuaguaacgacaacaguuucuaauauggcagaaguuagaaguuauugcuaugaagcuaguauaucagacauggcaagcgacaguagaugcccaacacaaggagaagcauauuuagauaaacaaagugauacacaauaugucugcaaacgaacucuaguagacagaggguggggaaaugguuguggauuauucgggaaaggaucauuaguuacaugcgcuaaauuugcauguagcaagaaaaugacaggcaaaaguauacaaccagaaaauuuagaauauagaauaauguuaucaguacacgggucgcaacauaguggaaugauuguuaaugacacaggccaugaaacagaugaaaacagggcgaaagucgaaauaacaccaaacuccccaagggcagaagcaacauuaggaggauuuggaagucuaggucuagacugugaaccaagaacugguuuagauuuuagugaucuauauuacuuaacuaugaauaacaaacauuggcuagugcauaaagaaugguuucaugauauacccuuaccauggcaugcaggagcagauacaggcacaccucauuggaauaauaaagaagcauugguagaauuuaaagaugcacacgcaaaacgccaaacaguaguaguacuaggaucacaagaaggugccguacauacagcacuagcuggugcacuugaagcagagauggauggcgcuaaaggacgauuaucaucaggacaccuaaaaugucgacugaaaauggauaaacuaagacuaaaagggguaaguuauucacuauguacagcagcauuuaccuuuaccaaaauaccagcugaaacauuacauggaacuguaacuguagagguacaauaugccgguacugauggaccauguaaaguaccagcacaaauggcaguagauaugcaaacauuaacgccaguaggaagauugauaacagcgaauccaguaauaacagaauccacagaaaacucaaaaaugaugcuagaauuagauccaccuuuuggagauucuuauauaguaaucggaguuggagaaaagaaaauaacucaucauuggcacagaucaggaaguacaauagguaaagcauuugaagccaccguaagaggagcuaaaagaauggcaguauuaggagauacagcaugggauuuugguaguguaggaggugcacuaaauucacuagguaaagggauacaucaaauauuuggggcagccuuuaaaucauuauuuggaggaaugaguugguuuucucaaauauuaauaggaacuuuauuaaugugguuaggacucaacacuaaaaacggaagcauaaguuuaauguguuuagcacuuggaggaguacuaauuuuucuaagcacagcaguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11544 - RNA, 2485 nt, Artificial Sequence
  ZIKV (strain ZikaSPH2015) prME-short variant mRNA Design 2 opt
ggggcgcugccuacggagguggcagccaucuccuucucggcaucaagcuuaccaugggacggaaacaaaacaaaagaggaggcaacgaaggcucaauaauguggcucgcaagccuagcaguaguaaucgcaugcgccggggcgguaacacgacgcggcucagcauacuacauguaccuggaccgcaacgacgccggcgaagcuauauccuuccccaccacgcucggaaugaacaaaugcuacauacaaauaauggaccuuggccacaugugcgacgcaacaauguccuacgaaugccccaugcuggacgaaggaguagaaccggacgacguagauugcuggugcaacaccacgaguaccugggucguauacggcacaugccaccacaaaaagggcgaagcacgccgaagccgacgagccgucacccugcccagccacagcacccgcaaacuccagacccgcagccaaaccuggcuggaaagccgagaauacaccaaacacuuaaucagagucgaaaacuggaucuucagaaaccccggauucgcucucgcagccgccgcaauagcauggcugcucggcucguccacaucacaaaaagucaucuaccuaguaaugauccuccugaucgccccagccuacagcauccgcugcauaggaguaagcaaccgugacuucguggaaggaaugucaggaggcaccuggguagacauaguccucgaacacggaggcugcgucacaguaauggcacaagacaaaccaaccgucgacaucgaacucguaaccacaaccguauccaacauggcggaggucagauccuacugcuacgaagccagcaucagcgacauggccuccgacuccagguguccaacccagggagaagcauaccucgacaaacaaucugacacccaauacgucugcaaacgaacccuagucgaccgaggguggggcaacggcugcggacuguucgggaaaggaagucuaguuacaugcgcaaaauucgccugcagcaaaaagaugacaggaaaaucaauacagccagagaaucucgaguacagaauaaugcucuccguccacggcucacaacacucaggcaugauaguaaacgacacgggacacgaaacagacgaaaacagagcaaaggucgagaucacacccaacagcccacgugcggaagcaacacugggaggcuuuggcagccuaggacuggacugcgaaccccgcaccggccucgacuucagcgaucucuacuaccucacgaugaacaacaagcacuggcugguccacaaggaaugguuucaugacauaccacuaccauggcacgcaggcgccgacacagggacaccccacuggaacaacaaagaagcacuggucgaguucaaagacgcgcacgccaaaagacaaaccguaguaguccuaggcucccaagaaggagcaguccacacggcacuagccggcgcgcucgaagcggaaauggacggagccaaaggaagacuaaguucaggacaccuaaaaugcagacuaaaaauggacaaguuacgacugaaaggagucucguacagccucugcacggcagccuucacauucaccaagauaccagcagaaacccuacacggcaccguaacggucgagguacaauacgccggaaccgacggaccaugcaaagucccagcacaaauggcagucgacaugcaaacccuaacacccgucggccggcuuaucacagcaaacccgguaaucacagaaaguacagagaacuccaaaaugaugcucgaacucgacccgcccuucggagacagcuacaucgucaucggcgucggcgagaagaaaaucacacaccacuggcaccggagcggaucaacgaucggcaaagcauucgaagccacaguaagaggugcaaaacgaauggccguccuaggggauacagcaugggacuucggcagcguaggcggcgcacugaacagccuugggaaaggcauacaccaaaucuucggagcagcauucaaaagccuguucggaggcaugagcugguucucucaaauccuaauaggaacccuccucauguggcucggccuaaacaccaaaaauggaagcaucagccucaugugccuagcacuaggaggcguccuaaucuuccugaguacagccguaagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11545 - RNA, 2485 nt, Artificial Sequence
  ZIKV (isolate Z1106033) prME-short variant mRNA Design 2 opt
ggggcgcugccuacggagguggcagccaucuccuucucggcaucaagcuuaccaugggccgaaaacaaaacaaacgcggaggcaacgaaggauccauaauguggcuagcuucccuggccguuguaauagcgugcgcuggcgccgucacacgacgaggauccgccuauuacauguaccucgaccgcaacgacgccggagaagcaauaucauucccgacaacccuugggaugaacaaaugcuacauacagaucauggaccucggacauaccugcgacgcaaccauguccuacgaaugcccaaugcuagacgagggagucgagccagacgacguggacugcuggugcaacaccacaagcacaugggugguauacggaaccugccaccacaagaaaggcgaagcccgucgaagcaggcgagcagugaccuuaccaagccacagcaccagaaaacuccagacacgcucacaaacauggcucgaaagcagggaauacacgaaacaccuaaucaggguagaaaacuggaucuuccgaaacccaggcuucgcccucgccgccgcagcaaucgcauggcuacuaggcucgagcacaagccaaaaagucaucuaucucgucaugauacuccuaauagcacccgcauacucaauacgaugcauaggugucagcaaccgcgacuucgucgaaggaaugagcggaggaaccuggguagacguaguccucgaacacggcggauguguaacagucauggcccaagacaaaccuacagucgacauagagcuaguaaccacgaccguaagcaacauggcagaaguacgaagcuacugcuacgaagccucgaucagcgacauggcaagcgacucccgcugcccaacccagggagaagcauaccuggacaaacaaagcgacacacaauacgucugcaaacggacacucgucgaccgcggauggggaaacggcugcggacuauucggcaaaggcagccuaguaacaugugcaaaauucgccuguuccaagaaaaugaccgggaaaucaauacaaccggaaaaccuagaauaccgaauaaugcucagcgugcacggaucacaacacucugggaugauaguaaaugacaccggccacgaaacugacgaaaaccgcgccaaaguagagaucacccccaacucgccccgcgcagaagccacacuaggcggcuucggaucccugggccucgacugcgaaccacgaacgggacuagacuucucagaucucuacuaccucaccaugaacaacaaacacuggcuaguccacaaagaaugguuccacgacaucccacuccccuggcacgccggagcagauaccggaaccccgcacuggaacaacaaagaagcgcuagucgaguucaaagacgcacacgcaaaaagacaaacggucgugguacuaggcucccaagaaggcgcaguccacaccgcucuggccggugcacuggaagcggaaauggauggcgcuaaaggccgccucucaagcggccaccucaaaugccgacuaaaaauggacaaacuacgccucaaaggggucagcuacagccuaugcacagcagccuucaccuuuaccaaaauaccagcagaaacccuacacgguacaguaaccguugaagugcaauaugcaggaacagacggacccugcaaagucccggcacaaauggcagucgacaugcagacccugacaccaguaggccgacuuaucacagccaacccagucaucaccgagucaacagaaaacuccaaaaugaugcucgagcuagacccaccauucggagauagcuacaucguaaucgggguaggggaaaagaagauaacacaccauuggcacagaagcggcagcacuauaggaaaagcauucgaagccacagugaggggagcaaaacgcauggccgugcucggcgacacagcaugggacuucggcuccguaggcggcgcccugaacagccugggaaaaggaauacaccaaauauucggagcggcauucaagucccuauucggcggcaugucaugguucucacaaauacugaucggcacacugcuaauguggcuaggccucaaugcuaagaacggcagcauaagccucaugugccuagcgcucgggggaguacuaaucuuucuaaguaccgccgugagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11546 - RNA, 2473 nt, Artificial Sequence
  ZIKV (strain MR 766) prME-short variant mRNA Design 2 opt
ggggcgcugccuacggagguggcagccaucuccuucucggcaucaagcuuaccaugggccguaaacaaaacaaacgaggaggcaacgaaggaagcauaauguggcuagccucccucgcaguaguaauagccugcgccggcgcaaucacccgccgaggcucggccuacuacauguaccuagacaggagugacgcaggcaaagccaucagcuucgcaacaacccucgggguaaacaaaugccacguacaaaucauggaccucggacacaugugcgacgccacgaugucauacgaaugccccaugcuagacgaaggagucgaacccgacgacguagacugcuggugcaacacaaccagcacgugggugguauacggaacaugccaccacaagaaaggagaagcacgaaggagcagaagggcagugacccuaccgagccacuccacccgcaaacuccaaacacggagccaaacauggcucgaaagccgagaauacacaaaacaccucauaaagguagaaaacuggaucuuccgcaacccaggcuucgcccuagucgccguagcaauagccuggcuacuagguuccagcacaucccagaaggucauauaccuggucaugauauuacuaauagcgccggcauacagcauucgaugcauaggcguaagcaaccgagacuucguagaaggcauguccggcggaaccugggucgacgucguacucgagcacggagggugcguaaccgugauggcccaagauaagcccacagucgacauagaacucguaaccaccacggucaguaacauggcagaagugagauccuacugcuacgaagcguccauaagcgacauggccucagacagccgauguccaacccaaggggaagccuaccuggacaaacaaucagacacucaauacgucuguaagagaacccuagucgacagaggauggggcaacggaugcggacuauucggcaaaggcucacucgucacaugcgcaaaauucacaugcuccaagaagaugacaggaaaaagcauacaaccagaaaaccucgaguacagaauaaugcucuccgugcacggcucacaacacagcggaaugaucggcuacgaaacugacgaagaccgcgcaaaaguggaggugacacccaacucaccccgcgcagaagccacccucggcggauucggcagccucggccuagauugcgagccacgaacaggccuagacuucagugaccuauacuaccuaacaaugaacaacaaacacugguuagugcacaaagaaugguuccacgauaucccacuacccuggcacgcaggcgccgacacagggaccccacacuggaacaacaaagaggcccucguagaguucaaagacgcacacgccaaacgacagacaguaguaguacugggaucucaggaaggcgcggugcacaccgcacuagcgggcgcccuggaagccgaaauggacggagcaaaaggacgccucuucuccggacaccugaaaugcagacucaaaauggacaaacugcgccucaaaggcgucagcuacagccugugcaccgcagcauuuaccuucacaaaagucccugcagaaacacuccacggaacagugacaguagaaguacaauacgccggcacagauggcccaugcaaaauacccguccagauggccgucgacaugcaaacccuuaccccagucggacgccucaucacagcaaacccggucauaaccgaauccacagaaaacucgaaaaugaugcuggaacucgacccacccuucggcgacaguuacauaguaaucgguguaggagacaagaaaaucacacaccacuggcaccgcagcggcucaacuaucggcaaagcauucgaggccacagucagaggcgcaaaacgaauggcuguccuaggcgacacagccugggauuucggcagcguaggcggcgucuucaacucccucggcaaaggaauacaccaaauuuucggggccgcauucaaaucacucuucggaggaaugucaugguucucgcaaauccucauaggcacccuccuaguauggcucggacucaauaccaaaaacggaucaaucagccuaaccugucuugccuuaggaggaguaaugaucuuccucagcaccgcagucagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11547 - RNA, 2485 nt, Artificial Sequence
  ZIKV (strain NatalRGN) prME-short variant mRNA Design 2 opt
ggggcgcugccuacggagguggcagccaucuccuucucggcaucaagcuuaccaugggccgaaagcaaaacaaacgcggcggcaacgaaggaucaaucauguggcucgccucccucgcaguaguuaucgccugcgccggcgccgucacgcgacgcggcucagcauacuacauguaccuggaccgaaacgacgcaggcgaagccauauccuuccccaccacccucggaaugaacaagugcuacauucaaaucauggaccugggucacaugugugacgccacaauguccuacgaaugcccaaugcuggacgaaggcgucgaaccagacgacgucgacugcuggugcaacacuacaucaacauggguaguauacgggaccugccaccacaagaaaggcgaagcacgacgcuccagacgagcagucacacugcccucccacuccacccgaaaacuacagacacggucccaaacauggcucgaaagcagggaauauaccaaacaccuaauccgcgucgagaacuggauauuucgaaaccccggcuucgcacucgccgccgccgccaucgccuggcuccuaggauccagcacaucacaaaaagucauauaccucguaaugauacuacucauagcgcccgcauacagcauaagauguaucggcguaagcaaccgagacuucguagaaggcaugucaggaggcacaugggucgauguaguccuagaacacggaggcugcguaacagucauggcccaagacaaaccaaccgucgacauagagcuagugacaaccaccguaucaaacauggccgaaguaagaucauacugcuacgaagccuccaucuccgauauggcaagcgacucacguugccccacccaaggugaagccuacuuagacaaacaaagcgacacacaauacgucugcaaaaggacccucguagaucgcggauggggaaacggcugcggacuauucgguaaaggaucgcucgugacaugugccaaauucgccugcuccaagaaaaugacaggcaaauccauccaaccagaaaaccuagaauaccgcauaaugcucucaguacacggaucccaacacagcggcaugaucgucaacgacacaggccacgaaaccgacgagaacagagccaaaguagaaauaacacccaauagcccacgcgcagaagccacacucggcggauucggaucucucggccucgacugcgagccacggacaggacuugacuuuuccgaccucuacuaccugaccaugaacaacaaacacuggcuagugcacaaggaaugguuccaugacaucccucuccccuggcacgcaggagccgacacgggcacaccgcacuggaauaacaaagaagcccucguagaguucaaggacgcacacgccaaacgacaaacggucgucguccuaggaucacaagaaggcgcaguacacacagcgcucgccggagcccuagaggcggagauggacggggcaaaaggccgccucuccaguggacaccucaagugccgacucaaaauggauaagcuccgacucaaaggcguaucuuacucccuaugcaccgccgcauucacauucacgaaaauccccgccgaaacccuccacggcacggucaccgucgaaguacaauacgcaggcaccgauggcccaugcaaaguaccagcacaaauggcaguggacaugcaaacacucaccccagucggacgacucaucaccgcaaacccagucaucaccgaauccaccgaaaacucaaaaaugaugcuagaacucgacccacccuucggcgauaguuacaucgucauaggcgugggggaaaagaagauaacacaucacuggcaccgaucaggguccacgaucggcaaagccuucgaggccacaguacgcggagcaaagcgcauggcaguccuaggagauacagccugggauuucgggaguguaggcggcgcccuaaacagccuaggcaaaggcauacaccaaauauucggcgccgccuucaaaagccuauucggaggcaugagcugguucagccaaauacucauaggaacgcuccucauguggcuuggacuaaacacaaagaacggaagcauaagccucaugugccuagcacuaggaggcguacuaaucuuccugagcaccgcggucagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11548 - RNA, 2458 nt, Artificial Sequence
  ZIKV (strain ZikaSPH2015) prME-short variant mRNA Design 2 opt
ggggcgcugccuacggagguggcagccaucuccuucucggcaucaagcuuaccaugaacgaagggucaaucauguggcuugcaucccuagcaguagugaucgccugcgcgggcgcggucacacgacggggcuccgccuacuacauguaccucgaccgcaacgacgcaggcgaagcaaucagcuuccccacaacgcuaggaaugaacaaaugcuauauacaaauaauggaccucggccacaugugcgacgcaaccaugagcuacgaaugcccaaugcuagacgaaggcguggaaccggacgacguggacugcuggugcaacaccacauccacaugggugguauacgguaccugccaccacaagaaaggcgaagcacgaaggucacggagagcagucacccuaccaucccacagcaccagaaaacuacaaacacgaucccagaccuggcuagaaagccgcgaauacacgaagcaucuaauaagggucgaaaacuggauauuccgaaaccccggauucgcacuagccgcagcggcaauagcauggcuacuagggucaagcacgucccaaaaaguaauuuacuuaguaaugauccuccuaauagcaccagccuacucaaucagaugcauaggcguaagcaaccgagacuucguagaaggcaugagcggcgggaccuggguagacauaguacucgaacacggaggcugcguaaccguaauggcacaagacaaaccaacaguagacaucgagcuaguaaccacaacaguaucgaacauggcggaaguacgcuccuacugcuacgaagccucgaucuccgacauggccagcgacucacgcugcccgacccaaggggaagcauaccuagacaaacaauccgacacgcaguauguaugcaaacgaacacugguugaccguggaugggggaauggaugcggacucuucggaaaaggcucgcucgucacaugcgccaaauucgccugcagcaagaaaaugaccggcaaaagcauucaaccagaaaaccucgaauaccgaaucaugcucagcguacacggcucacaacauagcgggaugauagucaacgacacaggacacgaaacggacgaaaaucgggcaaaagucgaaaucaccccaaacucaccacgcgcagaagccacacucggaggcuucggcagccuaggacuagacugcgaacccagaacgggacuagacuucagcgaccucuacuacuuaaccaugaacaacaaacacuggcugguccacaaagaaugguuccacgacauaccacucccauggcacgcaggcgccgacaccgggaccccacauuggaacaacaaagaagccuuaguagaguucaaagacgcgcacgcaaaaagacagacagugguaguacugggaagccaagaaggcgcaguccacacagcacuagccggagcgcuggaagccgaaauggacggcgccaaaggcagacuauccuccggacaccucaaaugccgccucaaaauggacaaacuacgccuaaaaggagucagcuacucacucugcacagccgcguucaccuucacuaaaauacccgcagaaacccuacacgggaccgucaccguagaaguacaauacgccggcacugacggaccaugcaagguaccagcccaaauggccgucgacaugcaaacccuaacucccguaggacgacucaucacggccaaccccguaauaaccgaaagcacagagaacucaaaaaugaugcucgaacuagacccacccuucggagacagcuacaucgucaucggcguaggcgagaaaaagauuacccaccacuggcacaggagcggcagcacgaucggaaaagccuucgaagccacagucagaggggccaaacgcauggccguacugggcgacacagccugggacuucggcaguguaggaggggcccucaacagccucggaaaaggcauccaccaaauuuucggagccgcuuuuaaaagucuauucggaggaauguccugguucucacaaauacucauuggcacacuccuaauguggcucggccuaaacaccaagaacggcagcaucagccuaaugugccuagcccucggcgggguacuaauauuccugagcacagccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11549 - RNA, 2458 nt, Artificial Sequence
  ZIKV (isolate Z1106033) prME-short variant mRNA Design 2 opt
ggggcgcugccuacggagguggcagccaucuccuucucggcaucaagcuuaccaugaacgaaggcucgaucauguggcucgccucccuagcagucgucaucgcaugcgcaggagcagucacccgccggggauccgcguauuacauguaccucgaccggaacgaugcaggagaagcaaucagcuucccgaccacacucgggaugaacaaaugcuacauacaaauaauggaccucggacauaccugcgacgcaaccauguccuaugaaugcccgaugcuugacgaaggagucgaaccagacgacguagacugcuggugcaacaccacaagcacaugggugguauacggcacaugccaccacaagaaaggagaagcgcgcaggaguagacgcgccgucacccucccaagccacucaacacgcaaacuccaaacacgaucacaaaccuggcucgaaagccgagaauacaccaagcaccuaauccgcgucgagaacuggaucuuccgcaacccaggauucgcgcucgccgcagcagccaucgccuggcuccuaggguccagcaccagccaaaaggugaucuaccuagucaugauacuccucaucgcaccagcauacucgauccgcugcauaggcguaucaaauagagacuucguagagggaauguccggcggaaccugggucgacguaguccuagaacacggcggcugugucaccgugauggcacaagacaaaccaacaguagacauagaacuuguaacaacgacaguaaguaacauggcggaaguccgcagcuacugcuacgaagcauccauaucagacauggccagcgacagccgcugccccacgcaaggcgaggcauaccuagauaagcaaucagacacccaauaugucugcaaaagaacccuaguggaccgcggcuggggcaacggaugcggccucuucgggaaaggcucccucgucacgugcgccaaauucgccugcucaaagaaaaugaccggaaaaagcauacaacccgaaaaccuagaauaccgaaucaugcucucgguacacggaucacaacacagcggaaugaucguaaaugacaccggacaugagacagacgaaaacagggccaaagucgaaaucaccccaaauaguccccgcgcagaagccacccucgguggguucggcagucucggacuagacugugaaccacgaaccggccucgacuucagcgaccuauacuaccuaacaaugaacaacaaacacuggcucguccacaaagaaugguuccacgauaucccgcuacccuggcacgccggagccgacaccgggacaccacacuggaacaacaaagaagcccucgucgaguucaaagacgcgcacgcuaaacgccaaaccguagugguccucggaucccaggaaggagccguacacaccgcacuagcaggagcccucgaggccgaaauggacggcgcaaaaggaagacucucaagcggccaccucaagugcagacucaaaauggacaaacuaagacugaaaggaguauccuacucccucugcacggccgccuucacauucacuaaaaucccagccgaaacgcuccacggaacaguaacaguggaagugcaauacgcgggaacugacggaccaugcaaaguacccgcccaaauggccgucgacaugcaaacacuaacaccagucgggcgacuaaucacagccaauccaguaauaacggaaucaaccgaaaacaguaaaaugaugcuagaacuagacccacccuucggagacagcuauauaguaaucggagucggagaaaagaaaauaacccaccacuggcacagaagcgggagcaccaucgggaaagccuucgaggcaacggugagaggcgcaaaacgaauggccguccucggagacaccgcaugggacuucggauccgugggcggagcccugaacucacuaggaaaaggcauccaucaaauauucggggccgccuucaaaucccucuucggcgggaugucgugguucucacagauacucaucgggacacuacucauguggcucgggcucaacgccaaaaacggaagcaucucacucaugugccuagcacuagggggaguccuaaucuuccuguccacagcaguaagcgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11550 - RNA, 2446 nt, Artificial Sequence
  ZIKV (strain MR 766) prME-short variant mRNA Design 2 opt
ggggcgcugccuacggagguggcagccaucuccuucucggcaucaagcuuaccaugaacgagggcucaaucauguggcuggccucacuagccguagugauagcaugcgcaggcgcaaucacacgccgggguucagcauacuacauguacuuagacagaagugacgcaggaaaagcaaucucauucgccacaacccuaggagucaacaaaugccacguacaaauaauggaccuaggccacaugugcgacgcaacgauguccuacgaaugccccauguuggacgaaggcguagagcccgacgaugucgacugcuggugcaacaccacgaguaccuggguagucuacggcacgugccaucacaagaaaggagaagccagaaggucgaggagagcagucacacugccgagccacagcacacgaaaacuccagacacgaucccagaccuggcucgaaagcagggaguacacaaaacaccucauaaaagucgaaaacuggaucuucaggaacccaggauucgcgcuaguagcaguagccaucgccuggcugcuagguagcagcacgucccaaaaagucauauaccucguaaugauccuauuaauagcaccagcauacucgauaagaugcauaggaguaaguaaccgagacuucguagaaggaaugucaggcggcacauggguagacguaguacuagaacacgguggaugcguaaccgugauggcacaagacaaacccacaguagacauagagcuaguaaccacgacuguaagcaacauggcugaaguccgaagcuacugcuacgaggcaucgaucuccgacauggccuccgacagccgcugcccaacacaaggagaagccuaccuagauaaacaaucggacacgcaauacgucugcaaacgcacucuagucgaccgcggauggggaaacggcugcggacuguucggaaaaggcagccuaguaacaugcgccaaauuuaccugcucaaagaaaaugaccggcaaaucaauacagccagaaaaucucgaauacagaaucaugcuaucaguacacggcucgcaacacagcgggaugaucggguacgaaacagaugaagaccgagcaaaaguagaagucacaccgaacagcccaagagcagaagccacacuuggaggguucggaucacuaggcuuggacugcgagccacgcacaggucuagacuucagcgaccuguacuacuugaccaugaacaacaaacauuggcuaguacacaaagagugguuucacgacauaccccuccccuggcacgccggcgccgacaccggcaccccacauuggaacaacaaagaagcgcuggucgaauuuaaagacgcgcacgcaaaacgacagacggucguaguacucgggagucaagaaggcgccguccacacagcccucgcaggggcgcuagaagcagaaauggacggggcgaaagggaggcuauucaguggccaccuaaaaugccggcucaaaauggacaaacuacgauugaaaggagucucauacucacuaugcaccgcggcguucacauucacaaaagucccggccgagacacugcacggaaccguaaccgucgaaguacaguacgcaggaaccgauggccccugcaagaucccgguacaaauggcggucgacaugcaaacccucacccccguaggacgacuaauaaccgcaaaccccgucauaacagaauccacagaaaacagcaaaaugaugcuagaacucgacccgcccuucggugacuccuacaucguaaucggugucggcgacaagaaaaucacacaucacuggcaccgaagcggcagcacaaucggaaaagcauucgaagccacagugcgcggcgcaaaacgaauggcaguacugggcgacaccgcuugggacuucggcagcgucgggggcguauucaacagucuaggcaaaggcauucaccagaucuucggagcagcguucaagagccuauuuggaggcauguccugguucagccagauucuaauaggcacacuucuagucuggcuaggacuaaacaccaaaaacggaagcaucagccuaaccugccucgcgcucggaggcguaaugauauuccuaagcacugccguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11551 - RNA, 2458 nt, Artificial Sequence
  ZIKV (strain NatalRGN) prME-short variant mRNA Design 2 opt
ggggcgcugccuacggagguggcagccaucuccuucucggcaucaagcuuaccaugaacgagggaagcauaauguggcucgcaucauuagcagucguaaucgccugcgccggagccgugacgagacgcggcuccgccuauuacauguaccuagaucgaaacgacgcaggcgaagccauaucauucccaacgacacuaggaaugaacaagugcuacauacaaauaauggaccuaggccacaugugcgacgcaaccaugagcuacgaaugcccaaugcucgacgaaggcgucgaacccgacgacguagacugcuggugcaacacuacauccacauggguagucuacggaacgugccaccacaaaaagggcgaagcaagacgaagcagacgcgccgucacacucccaagucacagcacccgaaaacuccaaaccagaagccagacauggcuagaauccagggaguacaccaaacaccuaauaagagucgaaaacuggaucuuccggaacccaggauuugcccuagcugcggcggcgauagcauggcuacucggcucaucaacaagccagaaagucaucuaccucguaaugauccugcucauagcaccagcguacucaauaagaugcauaggcgucagcaacagggacuucguugaaggcaugucaggcggcaccuggguggacguaguccucgagcacggaggcugcgucacaguuauggcacaggacaaacccaccgucgacaucgaacucgucacaaccacagucagcaacauggccgaaguccgcagcuacuguuacgaggcaagcaucagcgacauggccucggacuccaggugcccaacacaaggagaggcauaucuggacaagcagagcgacacacaguacgucugcaaacgaacgcuaguggaccgcggauggggaaacggcugcggacuuuucggcaagggaagccuaguaacuugcgcaaaguuugccugcucaaagaaaaugaccggaaaaagcauccaaccggaaaaccuagaauacagaaucaugcugagcguccacggaucccaacacagugggaugauaguaaacgacacaggacacgaaacagacgaaaaccgagccaaagucgaaaucacacccaacagcccgcgagcagaagcaacacucgggggcuucggaucacuaggacuagacugcgaaccacgcacagggcuagacuucagugaccuguacuaccuaacgaugaacaacaagcacuggcucguucauaaagaaugguuccacgacaucccccuaccguggcacgcaggggcagacacaggaacaccccacuggaacaacaaagaagcccucguggaguucaaagacgcacacgccaaacggcaaaccguaguaguccuuggaagccaggaaggagccguccacaccgcgcucgccggcgcccuagaagccgaaauggacggcgcaaagggacgacucagcagcggacaccuaaagugccgccuaaaaauggauaaacuccgccucaaaggcguaagcuacagccuaugcaccgccgccuucacauuuaccaaaauaccagccgaaacacuccacggcaccguaacagucgaaguacaauacgccgggacggacggaccaugcaagguccccgcccagauggcagucgacaugcagacccucaccccaguagggagacuaaucacagccaacccugucauaacggaauccaccgaaaacagcaaaaugaugcuagagcuagacccgcccuucggagacuccuacaucguaauaggcgucggcgaaaagaaaauaacacaucacuggcaccgaagcggcuccaccaucgggaaagccuucgaggccacaguaagaggagcaaaacgcauggcagugcuaggcgauacagcaugggacuucggcagcguaggcggggcgcugaacucccuaggaaaaggaauacaccaaauauucggagcagccuucaagucacucuucggcggaaugagcugguucucacaaauccuaaucggcacacuccuuauguggcucggccucaacaccaaaaacgggagcauaagccucaugugccuagcacuagggggcguccuaauauuucugagcaccgcggucagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11552 - RNA, 2485 nt, Artificial Sequence
  ZIKV (strain ZikaSPH2015) prME-short variant mRNA Design 2 opt
ggggcgcugccuacggagguggcagccaucuccuucucggcaucaagcuuaccaugggacggaagcaaaacaagagaggcggcaacgaaggcaguauaauguggcucgcaagccuagcgguaguaaucgcaugugcuggagccgucaccagacgaggguccgcauacuacauguaccuagacagaaacgacgcaggagaggcaaucuccuuccccacaacacuaggcaugaauaaaugcuacauacaaauaauggaucugggacacaugugugacgccacgauguccuacgaaugcccaaugcuagacgaaggagucgaaccagacgacguagacugcuggugcaacacaacgagcacaugggucguauacgggaccugccaccacaagaagggagaagcccgccggagcaggcgcgccgugacacuaccaagucauagcacacgcaaacuccaaacccgaucacaaaccuggcuagaaagccgugaauacaccaaacaccucauccgaguggagaauuggaucuuucgaaacccaggauucgcccuagccgcagccgcgauagcauggcuauugggcagcuccaccucccaaaaagugauauaccuagucaugauacuacuaaucgccccagcauacucgauucgguguaucggggugagcaaccgcgacuucguagaaggcaugagcggcgggacaugggucgacaucguacuagaacacggcgggugcguaaccguaauggcccaagacaaacccacagucgacauagaauuaguaacgaccaccgucagcaacauggcagaaguaaggucauacugcuacgaagccucuaucuccgacauggccagcgacagcagaugccccacccaaggagaggcauaccuagacaaacagagcgacacgcaauacgucugcaaaagaacacucguagaccgcggauggggcaacggaugcggacuguucggcaaaggcucccugguaaccugcgccaaauucgcaugcagcaagaaaaugacaggaaaaagcauacaacccgaaaaccuugaguacagaauaaugcucagcguccacggaagccaacacagcggcaugauagucaacgacacaggacacgaaaccgacgaaaaccgagcaaaagucgaaaucaccccgaacucaccacgugccgaagcaacacugggaggcuucggaucacuaggcuuagacugcgaaccacgcacaggacuugacuucuccgaucuguacuaccucaccaugaacaacaaacacuggcuagugcacaaagagugguuccacgacaucccccuccccuggcacgcgggagcagacaccggcacaccccacuggaacaacaaagaagcacugguugaguucaaggacgcacacgccaaacgccaaaccguaguggugcucggcucccaggaaggagccguacacacggcacucgccggugcacuagaagcagaaauggacggagccaaaggccgcuuaagcucuggccaccuaaaguguagacugaagauggacaaacuccgccucaaaggagucagcuacucacucugcacagcagccuucaccuucaccaaaauccccgcagaaacacuacacgggacagucaccguugaaguacaauacgcaggcaccgacggacccugcaaaguccccgcacaaauggcaguagacaugcaaacccucacaccagucggccggcuaauaaccgccaaccccgugauaacagaaagcaccgaaaacagcaaaaugaugcuagaacucgacccgccauucggggacucauacaucguaaucggcguaggagaaaagaaaauuacacaccacuggcaccguucaggcaguacccuaggcaaagcauucucaacaacccuaaaaggcgcacaacgacuagccgcccugggugacacagcaugggacuucggaagcauagguggaguauucaacagcaucggacgggccguccaucaaguguucggcggcgcauucagaacccuguucggcggcaugucuuggaucacacaaggacuaaugggggcccuccuauuauggaugggcguaaacgcaagagacagaaguauagcccuggcauuccuugccacaggcggaguacugguauuccuggccaccaacguccacgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11553 - RNA, 2485 nt, Artificial Sequence
  ZIKV (isolate Z1106033) prME-short variant mRNA Design 2 opt
ggggcgcugccuacggagguggcagccaucuccuucucggcaucaagcuuaccaugggcagaaaacaaaacaaaaggggagggaacgagggcagcauuauguggcuggccagccucgccgucguaaucgcgugcgccggugcaguaacacgcaggggaagcgcauacuacauguaccuagaccgaaacgacgcaggagaagcaauuagcuucccuacaacgcuaggaaugaacaaaugcuacauccaaauaauggaccuaggucacaccugugacgcaaccaugagcuacgagugucccaugcucgacgaaggcguagagcccgacgacgucgacugcuggugcaacacaaccuccacauggguaguauauggcacaugucaccacaagaaaggagaggcacgcagguccagacgcgcgguaacccuaccaagccacagcacuagaaaacugcaaacaagaucccaaaccuggcuagagagcagagaauacacaaaacaccucauccgaguagaaaacuggauauuccgaaaccccggcuucgcgcuagcugccgcagccauagccuggcuacucggaucgagcacaagccagaaaguaaucuaccugguaaugauacuucuaaucgcaccggcguacuccaucaggugcauaggaguaagcaaccgagacuucgucgaaggaaugagcggaggaacauggguagacgucgugcucgaacacggcggcugcguaacaguaauggcacaagacaaacccacaguagacaucgagcuagucacaacaacuguaagcaacauggcagaaguacgcagcuacugcuaugaagccucaauaucagacauggcaagugauucccgaugcccaacacaaggcgaagcguaccuggacaaacaaucggacacacaguacguaugcaaacgcacccuggucgaccgaggcugggggaacggauguggacuauuuggcaagggcagccucgucaccugugccaaguucgcgugcagcaaaaagaugacaggcaaguccauacaaccagaaaaccucgaguaccgaauaaugcuauccguacacggcucccaacacuccggcaugaucguaaacgacaccggacacgaaacugacgaaaaccgcgcaaaaguugaaauuacaccaaacucgccacgugccgaagcaacucuaggcggguucggaucccuaggccuggacugcgagccaagaacaggacucgacuucagugacuuauacuaccuaacaaugaacaacaaacacuggcuaguccacaaagagugguuccaugacauaccccucccauggcacgcaggggccgacacuggaaccccacacuggaacaacaaggaagcccuagucgaguuuaaagacgcacacgcgaagcggcaaaccguaguaguccucggaucccaagaaggagcgguucauacagcacucgcgggagcccuggaagccgagauggacggagccaaaggccgccugagcucaggacaccuaaaaugccgccucaaaauggacaagcuccgacugaaaggaguaucauacucccugugcaccgccgccuucaccuucacaaagaucccagcagagacccuccacggcacagugaccguagaaguacaauacgcaggaaccgacggaccaugcaaaguacccgcccagauggcagucgacaugcaaacgcuuacaccggucggacgccugauaacagccaacccaguaaucacagaaucaaccgaaaacucuaaaaugaugcuagaacucgauccacccuucggcgacagcuacaucgucaucggagucggagaaaagaaaauaacccaccacuggcaccgauccggauccacauuagggaaagcauucagcacuacacucaaaggcgcccaacgacucgcagcauuaggagacaccgcgugggacuucggcagcauaggaggagucuucaacucaaucgggcgggcaguccaccaaguguucgggggcgcauucaggacacuauucggcggcaugaguuggaucacacaaggacucaugggagcgcuccuccucuggaugggagucaacgcuagagaccgcagcauagcccucgcauuccucgcuaccggcggcgugcucguguuccuagccacgaacguacacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11554 - RNA, 2473 nt, Artificial Sequence
  ZIKV (strain MR 766) prME-short variant mRNA Design 2 opt
ggggcgcugccuacggagguggcagccaucuccuucucggcaucaagcuuaccaugggcagaaaacaaaacaaacgcgggggcaacgagggcucgauuauguggcucgcaucacucgcagucgugauagcgugcgcaggagcgauaacgaggagaggaagcgccuacuacauguaccuggacagaagcgacgcagguaaagcaaucucguucgcaacaacacuagggguaaacaaaugccacguccaaauuauggaccuaggccacaugugcgaugcgacgauguccuacgagugcccgaugcuagacgaaggcguggaaccagacgacguagacugcuggugcaacacaacgagcacauggguggucuacggaacaugccaucacaagaaaggcgaagcccgcaggagcaggcgagcggucacucucccaagccacagcacgcggaaacuacaaacaagaagccagacauggcuugaaagccgcgaauacacaaaacaccugaucaaagucgagaacuggauauuccgaaaccccggguucgcacucguagcaguagcaauagcauggcuacuaggcucgaguaccagccagaaaguaauauaccucgugaugauacuacugaucgcgcccgccuacagcauccgcugcauaggcgucagcaacagagauuucguagaaggaaugucaggaggaacaugggucgacgucguacuagagcacggaggcugcguaacgguuauggcccaggacaaaccaacggucgacaucgaacucgugacaacaacagucagcaacauggcggaagugcgaucauacuguuacgaagcaagcauaucagacauggcaucagacucaagaugcccuacucaaggagaggcuuaccuagacaaacaaagcgacacccaguacgucuguaaaagaacauuagucgaccgaggauggggaaacgggugcggacucuucggaaaaggcucacucguaacgugcgccaaauucacaugcuccaaaaagaugacgggaaagagcauacagccagaaaaucuagaguacagaaucaugcugucaguacauggcucgcagcacagcggaaugauaggcuacgaaacggaugaagacagagccaaagucgaagucacgcccaacagcccgagagcagaagcgacccuaggcggguucggaagccugggccuagacugcgaaccgcguacgggacuggacuuuagcgaccuauacuaccucacaaugaacaauaaacacuggcuaguccauaaagaaugguuccacgacaucccgcuaccauggcaugccggggcagacacaggaacaccccacuggaacaauaaagaggcccuaguagaguucaaagacgcgcacgcaaaacgccagaccgucgugguccugggaucacaagaaggagcgguccacacagcucucgcaggagcacucgaagcagaaauggacggcgcgaaaggccgacucuucagcggccaccuuaagugcaggcucaaaauggacaaacuacgacugaaaggggucucauacagccucugcacagcagccuuuacguucacaaaaguaccagccgaaacacugcacgggaccgugacaguggaagugcaauacgccgguacagacggacccugcaaaaucccaguccaaauggcgguggauaugcaaacccuaacuccggucggccgacuaauaacggcaaauccagugaucacagaaucaaccgaaaacucaaaaaugaugcuagaacuagacccgccauucggcgacagcuacauaguaaucggggucggggacaagaaaauaacgcaucacuggcacagaagcgggagcacacucggcaaggcuuucagcacaacacuaaaaggcgcgcaaagacuugcagcacucggcgauaccgcgugggacuucgggaguauaggaggagucuucaacucaauaggacgcgcaguccaccaaguauucggaggagcauucagaacccucuucggcggcauguccuggauaacccaagggcucaugggugcgcugcuucucuggaugggggucaacgcccgggacagaagcaucgcacuagccuuucuagcaacaggaggaguacuuguauuccucgccacaaacgugcacgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11555 - RNA, 2485 nt, Artificial Sequence
  ZIKV (strain NatalRGN) prME-short variant mRNA Design 2 opt
ggggcgcugccuacggagguggcagccaucuccuucucggcaucaagcuuaccaugggacgcaaacagaacaagagaggaggaaacgaaggcagcaucauguggcuagcaucgcuagcaguaguaaucgccugcgccggcgccgucacaagacgaggcucggcauacuacauguaccuagaccgcaacgacgccggugaagcuaucucguuccccaccacgcuaggcaugaacaaaugcuacauacaaauaauggaucucgggcacaugugcgacgccacaaugucguacgaaugccccaugcuagacgaaggagucgagccugacgauguugacugcuggugcaauaccacaagcaccugggucguauacgguaccugccaccacaagaaaggcgaagcacgcagaagccgccgggcggucacccugccgagccacagcacgcgaaaacuacaaacaagaagucagaccuggcuagaauccagggaauauaccaaacaccucaucagagucgaaaacuggaucuuccgcaaccccggauucgcgcuugcagcagcagcaauagcauggcuacucgggucaagcacgagccaaaaagucaucuaccucguaaugauacuacucaucgcaccagccuacagcauaagaugcauaggagucagcaacagagacuucguagaaggcaugaguggcggcacaugggucgacgucguacuggaacacgggggcugcgucaccguaauggcacaagacaaaccaaccgucgacaucgaacucguaacaacgacagugagcaacauggcagaaguaagaucauacugcuacgaagccucaauauccgacauggccagcgacucaagaugccccacacaaggagaagcauaccuagacaaacaaucggacacccaauaugucugcaaaaggacccuagucgacagaggauggggcaacggcugcggccucuucggcaaaggaucacucguaaccugcgcaaaauucgcaugcucaaagaaaaugacgggcaaaagcauccagcccgaaaaccucgaauacagaaucaugcucagcguacacggcagccaacacagcggaaugauagugaacgacacaggacacgagaccgacgaaaaccgcgcaaaagucgagaucacaccaaacagcccacgagccgaagccacacuaggaggcuucggaagccuaggauuagacugugaaccccguaccggccuggacuucagcgaccucuauuaccucacgaugaauaacaaacacuggcugguacacaaagagugguuccaugacauaccacugccuuggcacgccggagccgacaccggcacaccccacuggaacaacaaagaggcccugguggaguucaaagacgcgcacgccaaacgacaaacagucguggucuugggaucacaagaaggcgccguacauacagcacuagcgggagcccuagaagccgaaauggacggcgcaaaaggacgccuaagcaguggacaccuuaaaugccggcuaaaaauggacaaacuaagacugaaaggaguaagcuacucacuauguacagcagcauucacauuuacaaagaucccagccgaaacacugcacggaacuguaacagucgaaguccaauacgcaggcacagacggaccauguaaaguacccgcccaaauggcaguggauaugcagacccuaacccccguagggcgauuaaucaccgcuaaccccguaauaaccgaguccacagaaaacagcaaaaugauguuagaacucgacccacccuucggagacagcuacaucgucauaggagucggagaaaagaaaauaacacaccacuggcaccggagcggaagcacacucggaaaagcauucucaaccacgcuaaaaggcgcgcaacgacuagcggcgcucggcgacaccgccugggacuucgggagcauaggcggagucuucaacagcaucgggcgagccgugcaccaggucuucggaggagcauuccggacccuuuucggaggcaugucauggaucacacaaggccuaaugggagcacuccuccucuggaugggaguuaacgcaagagaccggagcauugcccucgcguuucuagccacagggggcguccuaguauuccuagccacaaacguacaugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11556 - RNA, 2458 nt, Artificial Sequence
  ZIKV (strain ZikaSPH2015) prME-short variant mRNA Design 2 opt
ggggcgcugccuacggagguggcagccaucuccuucucggcaucaagcuuaccaugaacgaaggcucuauaauguggcuugcaucgcucgccguuguaauagcaugcgcaggcgccguaaccagacgcggaagcgcguacuacauguaccuggaccgaaacgacgccggagaagccaucuccuuccccacaacacucggcaugaacaaaugcuacauacaaauaauggaccucggacacaugugcgacgccacgaugucauacgagugccccaugcucgacgaaggagucgaaccagacgacgucgacugcuggugcaacaccaccucgaccugggucgucuacggaaccugccaccacaagaaaggagaagcccgacgaagucgcagagccguaacacuccccucccacagcacacgaaaacuccaaacaaggucacaaaccuggcucgaaucccgugaauacaccaaacaccuaauccgagucgaaaacuggaucuucagaaaccccggauucgcacuagcagcagccgcaaucgcguggcuccucggcucauccaccucccagaaagucauauaccucgucaugauacuacuaauugcaccggcguacuccauacgcugcauaggcguaagcaaccgggacuucgucgaaggaauguccggaggcacguggguggauauaguccucgagcacggaggcugcgucacagugauggcacaagacaaaccaaccgucgacauagaacucgucacaaccacaguuagcaacauggcggaaguccgaagcuacugcuacgaagcaagcauaucggacauggcgucagacucacggugcccgacacaaggggaagccuauuuagacaaacaauccgacacgcaguacgucugcaaaagaacgcuagucgacagaggauggggcaacggauguggccucuucggaaaaggcagccuaguuacaugcgcaaaauucgcaugcucaaagaaaaugacaggaaaauccauacaacccgaaaaccucgaauaccggauaaugcucucaguacacggcucacaacacagcgggaugauaguaaacgacacaggacacgaaacagacgagaacagagcuaaagucgaaaucacaccaaacucgccacgcgcagaagcgacccuuggaggauucggcagccuaggccucgacugugaacccagaacaggccuagacuuuuccgaccucuacuaccucacuaugaacaauaaacacuggcuaguccacaaagaaugguuccacgacauaccccuacccuggcacgccggggccgacacaggaacaccccacuggaacaacaaagaagcacucguggaguucaaagaugcacacgccaaaagacaaacggucgucguacugggaucacaagaaggagcagugcacacagcgcuagcaggagcacuggaagccgaaauggacggcgcaaaaggccgccuaagcuccggacaccucaaaugccgacuaaagauggacaaacuacgacucaaaggaguauccuacucacuaugcacagcggcguucacauucaccaagauucccgccgaaacccuacacggaaccgugaccguagagguccaauacgcuggcaccgacggaccgugcaaaguaccagcacaaauggccguagacaugcaaacgcucacacccgucggccgccuaaucaccgcaaaccccguaauuaccgaaucaacagaaaacuccaaaaugaugcucgaacuagauccacccuucggagacuccuacaucguaaucggugucggugaaaagaaaaucacccaccacuggcacaggucaggauccacccucgggaaagcauucagcaccacacuaaaaggcgcucaacgccuagccgcccuuggugacacugcuugggacuucggcaguauaggcggcgucuucaacagcaucggacgcgccguccaucaaguauucgggggcgcauucaggacccuauucggaggaauguccuggaucacgcaaggccucaugggggcccuccuccuauggaugggagucaacgcccgcgaccgaagcaucgcccucgccuuccucgcaaccggaggcgugcucguguuccuggccacaaacguacacgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11557 - RNA, 2458 nt, Artificial Sequence
  ZIKV (isolate Z1106033) prME-short variant mRNA Design 2 opt
ggggcgcugccuacggagguggcagccaucuccuucucggcaucaagcuuaccaugaacgaaggcagcauaaugugguuagcaucccuagccguagugauagccugcgccggcgccgucacacgaagaggaucagccuacuacauguaccuugacagaaacgacgcaggagaagcaaucucauuccccaccacccucgggaugaacaaaugcuacauacaaaucauggaccuaggccauaccugcgacgcuaccaugagcuacgaaugccccaugcucgacgaaggcgucgaacccgacgacgucgacugcuggugcaacaccaccuccacuugggucguauacggaaccugccaccacaagaaaggcgaagcacgccgaucccgccgagcugucacacuacccagccacagcacgcgcaaacuccaaacacgaagccaaaccuggcuggaaucccgggaauacacaaaacaccugauccgagucgagaacuggauauuccguaaccccggcuucgcccuugccgcagccgccaucgccuggcuccuagggagcuccacgagccaaaaagucauauaccucgucaugauccuccuaaucgcacccgccuacagcauaagaugcauaggcgucucaaaccgagacuucguagaaggcaugucaggcggcaccugggucgacgucguccuagaacacggagguugcguaacggucauggcacaagacaaaccaaccgucgacauagaacucgucaccaccacaguaagcaacauggccgaaguacgauccuacugcuacgaagcauccauauccgacauggcaagcgacucacgcugccccacacaaggggaagcauaccuugacaaacaguccgacacccaguauguaugcaaacggacccuaguagaccguggcuggggaaacggcugcggccucuucggcaaaggaucacucgucacaugcgcaaaauuugcgugcuccaagaaaaugacaggcaaaaguauacagccugaaaaccuagaauaccgcauaaugcuaagcguccacggcagccaacacuccggcaugauuguaaacgacaccggccacgagacagacgaaaaccgcgccaaagucgaaauuacccccaauucaccaagagcagaagcaacccuaggcggcuucgggagccucggacuagacugcgaaccacggaccggucucgacuuuagcgaccuauacuaccugacuaugaacaacaaacacuggcucguacacaaagaaugguuccacgacauaccccucccauggcacgccggcgccgauaccggcacaccccacuggaacaacaaagaagcgcuaguugaguucaaagacgcacacgcaaaacgacaaaccguaguaguccucggcucgcaagaaggggccguccauaccgcccucgcuggagcccucgaagccgaaauggacggagcaaaaggccgccucagcuccggccaccucaaaugcaggcucaaaauggacaaauuaagacucaaaggcgugucauacagccuaugcaccgccgccuucaccuucacaaaaauaccggcagaaacccuacacggcacagucacaguagaaguccaguacgcaggaacagacggccccuguaaagucccagcgcaaauggcaguugacaugcaaacccucacccccgucggcagacucaucacagcgaacccagucaucacagaaucaacagaaaacaguaaaaugaugcuagaacuugacccacccuucggggacagcuacauagucaucggcguaggggaaaagaaaauaacacaccacuggcaccgcucagguagcacacuaggcaaagccuucucaacaacccuaaaaggcgcacaacgcuuagccgcccuuggcgacaccgccugggacuucgguagcaucgguggaguauucaacuccaucgggcgagcgguacaccaggucuucggaggugcguuccggacccuauucgggggcaugucauggaucacccaagggcuaaugggagcucuccuccuauggaugggcguaaacgcacgagaccgguccauagcacucgccuuccuagcaaccgguggcguucuaguguuccuagccaccaacguacacgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11558 - RNA, 2446 nt, Artificial Sequence
  ZIKV (strain MR 766) prME-short variant mRNA Design 2 opt
ggggcgcugccuacggagguggcagccaucuccuucucggcaucaagcuuaccaugaacgaaggaucaaucauguggcuagccucccuagccgucguaaucgcaugcgcaggagcaauaacuagacggggaucagcauacuacauguaccucgaccgcagcgacgccgggaaagcaauauccuucgcaaccacacucggagucaacaaaugccacguccagauaauggaccucggacacaugugcgacgccacaaugucguacgaaugccccaugcuagacgaaggaguagaacccgacgacgucgacugcuggugcaacaccacaagcacauggguggucuacggcacuugucaccacaagaaaggcgaagcacgacggagccgcagagccgucacccucccaagccacagcaccagaaaacuacaaacccgcagucaaacauggcuagaaaguagggaauacacaaagcaccugaucaaaguagaaaacuggauuuuccgcaaccccggcuucgcgcucguagccgucgcgauugcauggcuccuaggcuccucaaccucccaaaaaguaauauaccuaguaaugauucuccucaucgcccccgccuacuccauccgcugcauaggcguaagcaaccgcgacuucguagagggaaugaguggcggaaccugggucgaugucguacuagaacacggaggaugcguaacaguaauggcccaagacaaacccacgguagauauagaacucguaacuaccaccguauccaacauggcagagguccgcucuuacugcuacgaagccuccaucucagacauggcaagcgacagccgcugccccacccaaggcgaagcguaccucgauaagcaauccgacacccaauacgucugcaagagaacccucguagacaggggaugggguaacggaugcggacuauucggaaagggcagccuaguaaccugcgcaaaauucacaugcuccaaaaagaugaccggcaaaucaauccaacccgaaaaucucgaauacagaauaaugcuaucaguccacggaucgcaacacuccgggaugauuggcuacgaaacagacgaagaccgggccaaggucgaaguuacgccuaacagcccccgcgcggaagcaacccuaggcggguucggaagucuaggccuggacugcgaaccgcgaaccggccucgacuucagcgaccuguauuaccucacaaugaauaacaaacacuggcucguccauaaagagugguuccacgacaucccccucccauggcacgcaggggccgacaccggcaccccacacuggaacaacaaagaagcccucguagaguucaaagacgcccacgccaaaaggcagacugucgucguacuaggcagccaagaaggcgcaguccacaccgcccuagcaggcgcacuggaagcagaaauggauggagcaaaaggacgccucuucaguggacaccucaagugccgacuaaagauggacaaacuucgacuaaaaggcgucucguacucacucugcaccgcagccuucaccuucacaaaaguaccggcagaaacacugcacgggacaguaaccgucgaaguccaauacgccggaacagacggcccaugcaagauucccguacaaauggcagucgacaugcagacccugacccccgucgggcgccuaaucacagcaaacccagugaucacagaaucaaccgaaaacuccaaaaugaugcuagaacuugaucccccauucggcgacuccuacaucgucauaggcguaggcgacaagaaaaucacccaccacuggcacagaagcggaagcacacucggcaaggcauuuucaaccacucuaaagggagcccaacgccuagcagcccuaggagacaccgcaugggacuucggaagcaucgguggcguuuuuaauucaauuggacgcgcaguucaccaggucuucggaggcgcauuccgaacacuauuuggaggaaugagcuggaucacccaagggcucaugggcgcgcuccuacuauggaugggagucaacgcacgcgacagauccauagcccucgccuuccucgcaacagggggagugcucguauuccucgcaaccaacgugcacgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11559 - RNA, 2458 nt, Artificial Sequence
  ZIKV (strain NatalRGN) prME-short variant mRNA Design 2 opt
ggggcgcugccuacggagguggcagccaucuccuucucggcaucaagcuuaccaugaacgaaggauccaucauguggcucgcgucacuagccguaguaaucgcgugugccggagccguaacccgaagaggcucggcauacuacauguaccucgaccgaaacgacgcgggugaagcaaucuccuuccccaccacacucgggaugaacaagugcuacauacaaauaauggaccucggacacaugugcgacgcaacaauguccuacgaaugcccaaugcuggacgaaggcguggaaccagacgacgucgacugcuggugcaacacaacaagcacaugggugguuuacgggaccugccaccacaagaaaggcgaagcacgccgaucccgcagagcagucacacucccgagccacagcacacgcaaacuacaaaccagaagccagacaugguuagaaagccgagaauacacaaaacaucuuauccgaguagaaaacuggaucuuccgcaaucccggguucgcacucgccgccgcagccaucgcauggcuccugggcucaagcacaucccaaaaaguaaucuaucuagugaugauccuccugauagcccccgccuacucaauacgcugcauaggaguuagcaaccgcgacuucguggaaggaauguccggcggcacaugggucgacgucguccuagaacacggcggauguguaaccgucauggcgcaagacaaacccacggucgacauugagcuaguuacgacaacaguaagcaauauggcagaaguccgauccuacugcuacgaagccucaauaagcgacauggccucagacucgcgcugccccacccaaggagaagccuaccucgacaaacaaucugacacccaauacgucugcaaacgaacccuagucgacagaggguggggaaacggaugcggccuuuucggaaaaggcagccucgugaccugcgccaaauucgcgugcucgaagaaaaugaccggcaaaagcauacaaccagaaaaccuagaauauagaaucaugcucuccguccauggcucacaacacagcggcaugauaguaaacgacacaggccacgaaaccgacgaaaaccgagccaaaguagaaauaacacccaauucccccagagcagaagcuacacuagguggcuucgggucccugggacucgacugcgaaccacgaaccggacuagacuucagcgaccucuauuaccuaaccaugaacaacaaacacuggcuaguccacaaagaaugguuucacgacauaccgcuaccauggcacgccggagcugacacagggacaccacacuggaacaacaaagaggcccugguagaguucaaagacgcgcacgcgaaacggcaaacagucguaguccugggcucccaggaaggcgcgguccacaccgcucucgccggcgcccuagaagccgaaauggacggcgccaaaggaagacugagcagcgggcaccugaaaugcagacucaaaauggacaaacugcgccuaaaaggagucuccuacagccucugcacagccgcauucaccuucacaaaaauccccgcagaaacccuacacgggacaguaaccguugaaguacaauacgcagggaccgacggaccaugcaagguaccggcacagauggcagucgacaugcaaacacuaaccccagucggccgccuaauaaccgcaaacccaguaauaacagaauccacagagaacucaaaaaugauguuagaacucgaucccccauucggcgacagcuacauagucauuggcgucggagagaaaaagauaacccaccacuggcacagaagcggauccacccuaggcaaggcauucucaaccacccuaaaaggcgcccaaagacuugcagcacucggcgacacagcgugggacuucggaagcauaggaggagucuucaacucaauagggagagcgguccaccaagucuucggcggagcguucagaacccuauucggcggcaugucauggauaacgcaaggacuaaugggcgcccuacuacuauggaugggcgucaacgccagggacaggagcauagcacuggcauuccuagccaccggcgggguccucguguuccuggccaccaacgugcacgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11560 - RNA, 2485 nt, Artificial Sequence
  ZIKV (strain ZikaSPH2015) ME variant mRNA Design 2 opt
ggggcgcugccuacggagguggcagccaucuccuucucggcaucaagcuuaccaugggcagaaaacaaaacaaacgcggcggcaacgagggcucgauaauguggcuggccucauuagcaguagucauagccugcgccggagccgucacccgccgagggagcgcauacuacauguaccuagaccgcaacgacgccggagaagccauauccuuccccacuacacucggaaugaacaaaugcuacauccaaauaauggaccucggccacaugugcgacgccacgauguccuacgagugccccaugcucgacgaaggggucgaaccagacgacguagacugcuggugcaauaccacaucaaccuggguagucuacggaacuugccaccacaagaaaggcgaagcucgccgcagccgccgagccguaacccuaccaucccacagcacgcggaaacuacagacccgaagccaaacauggcucgaaagccgcgaauacacgaaacaccuaauaagagucgagaacuggaucuuccgaaaccccggauucgcccucgccgcagccgcaaucgcguggcuacucggcuccucgacgucccagaaaguaaucuaccuagugaugauacuacucauagccccagccuacucaauccgaugcaucggggucagcaaccgggacuucguagaagggaugagcggcggaaccuggguagacauaguccuagaacacggcgggugcgugacagucauggcccaagacaaaccgacaguagacauagagcuagucaccaccacgguaaguaacauggccgaaguccgcagcuacuguuacgaagcaagcaucucagauauggccagcgacucaagaugcccaacacaaggggaagcauaccucgacaaacaaagcgacacacaguacgucuguaaacgcacccuaguagaucgaggauggggcaacggcugcggacuauucgggaaaggcagccucguaaccugcgccaaauucgccugcuccaagaaaaugaccgggaaaucgauacaaccagaaaaccucgaauaccgcauaaugcugaguguacacggcagccagcacagcgggaugauagugaacgacacaggccacgaaacggacgaaaaccgcgcuaaaguagaaaucaccccaaacucaccccgagcugaagcuacccuagggggcuucggcagucugggacuagacugcgaacccagaaccggccuugacuucagcgaccucuacuaccuuaccaugaacaacaaacacuggcucguccacaaagagugguuccacgacaucccccucccauggcaugccggagcagacacgggcacaccccacuggaacaauaaggaagcccucguagaguucaaagacgcccacgccaaacgccaaaccguaguaguccucggcucccaagaaggagcaguucacacagcacucgcgggcgcccucgaagcagaaauggacggcgccaaaggccgccucagcagcggacaccuaaagugccgacuaaaaauggacaagcuacgccucaaaggggucuccuacagccucugcacggccgccuucaccuucacaaaaauaccagcggaaacacuccacggcacaguaaccgucgagguacaauacgccggcaccgacggccccugcaaaguaccagcccaaauggccgucgacaugcaaacccucacacccgucggacgacuaauaaccgcuaacccagucauuacagaauccaccgaaaacaguaagaugaugcucgagcucgacccgcccuucggcgacucauacaucguaauaggcgucggcgagaagaagauaacccaccacuggcaccgcucaggaagcaccauaggcaaagccuucgaagcgacaguacgaggcgcaaaaagaauggcgguccuaggagauaccgccugggacuucggcucagucggaggagcacuaaacagccuaggcaaaggaauccaccaaaucuucggugccgccuucaagucgcuauucggaggcauguccugguucagucaaauccucaucggcaccuuauuaauguggcuaggacugaacacuaaaaacggaaguaucagccucaugugucuagcccucggcggaguacuaaucuuccucucgacagccgucuccgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11561 - RNA, 2485 nt, Artificial Sequence
  ZIKV (isolate Z1106033) ME variant mRNA Design 2 opt
ggggcgcugccuacggagguggcagccaucuccuucucggcaucaagcuuaccaugggacgaaagcaaaacaagcgcggagggaacgaaggauccaucaugugguuagccucacucgcaguagucauagccugcgccggcgccgucacaagaagaggauccgccuacuacauguaccuugaccgaaacgacgcaggcgaagccaucuccuuccccacaacccuggggaugaacaaaugcuacauacaaauaauggaccucggccauaccugcgacgcaaccaugagcuacgaaugcccaaugcuagaugaaggcguagaacccgacgacguugacugcuggugcaacacaaccuccacguggguuguauacggaaccugccaccacaagaaaggcgaggcacgccgcagccgacgagcagucacacuacccagccacaguacaagaaaacuccaaacgcgaagccaaacauggcucgagagcagagaauacaccaaacaccucaucaggguagagaacuggauauucagaaaccccgguuucgcccucgcagcugcagccauagccuggcucuugggcucauccaccagccaaaaaguaaucuaccuggugaugauauuacucaucgcccccgcguacucgaucagaugcaucgguguuuccaaccgagacuucgucgaagggaugagcggcggaaccuggguagacguaguccucgaacacggaggaugcgucacaguaauggcccaagacaaacccacagucgacauagagcuaguuaccaccaccguaaguaauauggcagaagugcgcucauacugcuacgaagcaucaaucucugacauggccucugacucccgaugccccacacagggagaggccuaccuagacaaacaauccgacacccaauacguaugcaaacgaacacucgucgaccgcggcuggggcaacgggugcggacuauucggaaaaggaucacucguaaccugcgccaaauucgccugcucaaagaaaaugacaggcaaaagcauccaacccgaaaaccucgaauaccgcaucaugcucuccguccacggaucccagcacuccggcaugauagucaacgacaccggacacgagacagacgaaaaccgcgcaaaagucgaaaucacaccaaacagcccccgagcagaagcaacacucggaggcuucgguucccucggccuugacugcgaacccagaacaggccuagauuucagcgaccucuacuaucucaccaugaacaacaaacacuggcucguccauaaagagugguuccacgacaucccccuacccuggcacgccggagccgauaccggcaccccacacuggaacaacaaagaagcccucgucgaguucaaagacgcgcacgcgaaaagacaaaccgucgucguccugggcucccaagaaggggcaguccacacugcccucgccggugcacuagaagcagaaauggacggcgcaaagggccgacugaguagcggucaccugaaaugcagacucaaaauggacaaacuccgacucaaaggagucucauacucacuaugcaccgccgcguucacauuuacaaaaauacccgcggaaacgcugcacggcacagugaccguagaaguacaauacgccggcaccgacggaccaugcaaagucccagcccaaauggcagucgacaugcaaacucucaccccaguuggccgacuaauaacagcaaacccuguaauaacagaaucaacagagaacuccaaaaugaugcucgaacucgacccgcccuucggagacagcuacauagucaucggggucggcgagaaaaagauuacccaccacuggcacaggagcgggagcaccaucggcaaagcauucgaagccacagucagaggcgcgaaacgcauggccguccuuggcgacacagcaugggauuucggaagcguaggcggggcauuaaacucacucggaaaaggcauacaccagaucuucggagccgccuucaaaagccuauucgggggcaugaguugguucucccaaauacuuaucggaacacuacucauguggcuaggccucaacgccaaaaacgguucuauaucacuaaugugccuagcccucggcggcguccuaaucuuccucagcacggccgucucagccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11562 - RNA, 2473 nt, Artificial Sequence
  ZIKV (strain MR 766) ME variant mRNA Design 2 opt
ggggcgcugccuacggagguggcagccaucuccuucucggcaucaagcuuaccaugggucgcaaacaaaacaaacgaggcgggaacgaaggcagcauaauguggcucgccucccucgcagucgucauugccugcgcgggggcaauaacacggagaggaucggccuacuacauguaccuagaccgcagcgaugcaggaaaagcgaucagcuucgcgaccacgcuaggcgucaacaaaugccacguacaaaucauggaccucggacacaugugcgacgcaacaaugucauacgaaugccccaugcuagacgaaggaguagaaccagacgacguagacugcuggugcaacaccacgagcacaugggucguauacggcacaugccaccacaagaaaggggaagcgcgccgcagccgacgcgcagucacacuuccaagccacagcacacgcaagcuccaaacccgaagccagacauggcucgaaagccgggaauacaccaaacaccugaucaaaguagagaacuggaucuuccgaaaucccggcuucgcccucguagccguggccaucgcguggcuccugggaucgagcacaagccaaaaaguaaucuaccugguaaugauacuccuaaucgcucccgcauacucaaucagaugcaucggcguaagcaaucgcgacuucgucgaaggcaugagcgggggaaccuggguagacgucguacucgagcacggcggcugugucaccgugauggcccaggacaagccaacagucgacaucgagcuaguaaccacaaccguguccaacauggcagaaguacgaucauacugcuacgaggcauccaucucagacauggcaucagacucgcgcugucccacacaaggcgaagcguaccuagacaaacaaucagacacccaguacguaugcaaacgaacccuagucgaccgcggauggggcaacggaugugggcuauuuggcaaaggcucacucgugaccugcgcaaaauucacaugcagcaagaaaaugaccggaaaaagcauccaaccggaaaaccucgaauaccggauaaugcugucgguccacgggagucagcacagcggcaugauaggauacgaaacagacgaggacagagcaaaagucgaagucacaccaaacuccccgcgggcagaggccacccuggguggcuucggcagccuaggacuggacugcgaaccacgcacaggccuagacuucuccgaccuauacuaccuaacaaugaacaacaaacacuggcuagugcacaaagaaugguuccacgacaucccccuccccuggcacgcaggcgcagauaccggaacaccacacuggaacaacaaggaggcccuaguagaguucaaagacgcacacgccaaacgacaaacuguaguaguccugggaucccaagaaggugcgguacauacagcccucgcaggcgcacuggaagcagaaauggacggagcaaaagggcgccucuucuccggccaccuaaagugccgccuuaaaauggacaaacugagacugaaaggugucagcuacagucuaugcaccgccgccuucaccuucaccaaaguccccgccgaaacccugcacggaaccguaacagucgaaguacaauacgccggcaccgacggaccgugcaaaauaccaguccaaauggcgguugacaugcaaacucuaacccccgucgggcgccuaauaacagcaaauccggucaucacggaaucaaccgaaaauucaaagaugaugcuugaacuagacccacccuucggcgacagcuacauagucauaggagucggagacaagaaaauaacccaccacuggcaccgaucgggcuccacaaucggaaaagccuucgaagccacgguaagaggagcaaaacgaauggccguacuuggggacacagcgugggacuucgggagcgucggaggagucuucaacucacuagggaagggaauccaccaaauauucggagccgcguucaaaucacuguucggaggaaugagcugguucucccaaauacuuaucggcacacuccucgucuggcucggacuaaacaccaaaaacggcagcauaagccugacaugucucgcguuaggcggaguaaugauauuccucuccacagccgucagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11563 - RNA, 2485 nt, Artificial Sequence
  ZIKV (strain NatalRGN) ME variant mRNA Design 2 opt
ggggcgcugccuacggagguggcagccaucuccuucucggcaucaagcuuaccaugggccgaaaacaaaacaaaagaggaggcaacgaaggcagcaucaugugguuagccucccuggccguagucaucgccugcgcaggcgccguaacccgccgcggcucagcauauuacauguaccuggaccgaaaugacgccggcgaagccauauccuucccaacgacacuaggaaugaacaaaugcuacauccaaaucauggaccucggccacaugugcgacgcaacaauguccuaugaaugcccaaugcuggacgaaggcguagaacccgacgacguagacugcugguguaacaccaccaguacaugggugguauacggcacaugccaccacaagaaaggcgaagcgcgcagauccaggcgcgcagucaccuuaccuagccacagcaccagaaaacuacaaacccgaagucaaaccuggcuagaauccagagaauacaccaaacaccugauccgcgucgagaauuggaucuuccgcaaccccggauucgcacucgcagccgcagcaaucgcauggcuacuggggucuuccacaucgcaaaaggugaucuaccugguaaugauccuccucauagcucccgcguacucaaucaggugcaucggaguauccaacagagacuucguagaaggaauguccggcgggaccugggucgauguaguacuugaacacggggguugcguaacggucauggcacaagacaaaccaaccguagacauagagcucgucacaaccacagucagcaacauggcggaaguucgaucauacuguuacgaagccagcauaucagacauggccucggacagccgaugcccaacacaaggagaggcauaccucgacaaacagagcgacacacaauacguaugcaaacgcaccuuggucgaccgcggcuggggaaacggaugcggacucuucggaaaaggcucccuaguaaccugcgccaaauucgcuugcucaaagaaaaugaccggaaaaagcauacaaccagaaaaccuugaauaccgaauaaugcucucgguccacggcucacaacacagcggaaugauagucaacgacacgggccacgaaaccgaugagaacagagccaaagucgagaucacaccaaacagcccccgagcagaggcaacacucggcggguucgguagccuaggacuagacugcgaaccacgaaccggcuuagacuucagcgaccuuuacuaucuaaccaugaacaacaaacacuggcucguccacaaagaaugguuccacgacaucccacuccccuggcacgcaggagccgacaccggcacuccccacuggaacaacaaagaagcccuagucgaguucaaagacgcacacgcaaaacgccaaaccgucgucguacugggcucacaggaaggagccguacacaccgcacuagccggagcgcucgaagcagaaauggacggcgcaaagggcagacuaucaagcggccaccugaaaugcaggcuaaaaauggacaaacuccgacucaaaggagucuccuacagccucugcacagcugccuucacauucaccaagaucccagccgaaacccugcacggaacagucaccgucgaaguacaguacgccggaaccgacggccccugcaagguacccgcccaaauggccgucgacaugcagacccugacaccaguaggacgacucauaacugcaaauccaguaaucaccgaaucaaccgaaaacucgaagaugaugcuggaacucgaucccccauucggcgacuccuacaucgucauaggggucggcgagaaaaagauaacccaccacuggcaccgcagcggcagcaccauaggaaaagcguucgaagcaaccguaagaggagcuaaaagaauggcagugcugggcgacacagccugggacuucggcucagugggaggcgccuuaaacucgcucggaaaaggcauccaccagauauucggagcagcauucaagagccucuucggcggaaugaguugguucucucaaauccucaucggcacccucuugauguggcucggccuaaacaccaaaaacggaagcaucucccucaugugccucgcccuaggaggcguccucauauuccuaagcacagcaguauccgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11564 - RNA, 2458 nt, Artificial Sequence
  ZIKV (strain ZikaSPH2015) ME variant mRNA Design 2 opt
ggggcgcugccuacggagguggcagccaucuccuucucggcaucaagcuuaccaugaacgaaggcuccauuauguggcuagcaucacuagcggucgucaucgccugcgccggcgccgucaccagacgcggcuccgcuuacuacauguaccuggaccgaaacgacgccggagaagcgauauccuucccaacaacacucgguaugaacaaaugcuacauccaaauaauggaccucggccacaugugcgacgcaaccaugucauacgaaugccccaugcuggacgaaggagucgaacccgacgacgucgacugcuggugcaacacaacaagcaccugggucgucuauggcacaugccaccacaagaaaggggaagcccggcgcagcaggcgcgcgguaacacuccccagccacuccacccgaaaacuccaaacccgcagucagacauggcucgaaucccgcgaauacaccaaacaccugauccgcguugaaaacuggaucuucagaaacccaggcuucgcccucgccgccgcagcaaucgccuggcuacugggcuccucgacaagucaaaaagucauuuaccuaguaaugauccuccuuauagccccagccuacucaaucagaugcaucggggucuccaaccgagacuucguagaaggaaugucgggcggaacauggguagacaucguccucgaacacggcggaugcguaaccgugauggcccaagacaaaccaacagucgacauagagcuagucacaacaacaguaucaaacauggccgaaguacgauccuacugcuacgaagccucuaucucagacauggcgucggacagccgcugcccgacacaaggcgaagccuaccuagacaagcaaucggacacccaauacgucugcaaacggacccuugucgaccguggcuggggcaacggcugcggccuauucggcaaaggaucacucguaaccugcgccaaguucgcaugcuccaagaaaaugacgggcaaaagcauccagcccgaaaaccuagaauaccgaaucaugcucucaguccacggcucacaacacagcggcaugauagucaacgacacuggacacgaaaccgacgaaaacagagccaaagucgaaaucacccccaacagccccagagcggaagcuacgcucggcggcuucgguucccucggccuagacugcgagcccagaaccggccucgacuucagcgaccucuacuaccucacaaugaacaacaaacauuggcugguccacaaagaaugguuccacgacauaccgcuaccauggcaugcaggcgccgacacuggaacgccccacuggaacaacaaagaggcacucgucgaguucaaagacgcacacgcaaaacgccaaaccgucgucguacuaggcucacaagaaggcgccguccauaccgcacucgcaggggcacuggaagccgagauggauggagccaaaggccgacucagcuccggccaccucaaaugccgacuaaaaauggacaaacuacgacuaaaaggcgucucuuacucacuauguaccgcagcauuuacauucacgaagaucccagcugaaacccuccacggaaccguaaccgucgagguccaauacgccggaaccgacggcccaugcaaggucccagcccagauggccguagacaugcaaacccuaacaccuguaggaagacuaaucaccgcaaaccccguaaucaccgaauccaccgaaaacagcaaaaugaugcucgaacuggacccacccuuuggcgacuccuacauagugauuggcgucggugagaaaaagauaacccaccacuggcacaggagcggcagcaccauaggcaaagccuucgaagcuacagucagaggagcaaaaagaauggccguccucggcgacacagccugggacuucgguuccgucggcggcgcccuaaacucgcuuggaaagggcauccaccaaauauucggcgcagcauucaaaucacuauucggcgggaugucaugguucucccaaauacucauuggcacucuccuaauguggcuaggccucaacaccaaaaacggcucuaucagccucaugugccucgcccuagguggcguacuaauauuccucucgaccgcaguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11565 - RNA, 2458 nt, Artificial Sequence
  ZIKV (isolate Z1106033) ME variant mRNA Design 2 opt
ggggcgcugccuacggagguggcagccaucuccuucucggcaucaagcuuaccaugaacgagggcucuaucauguggcuagcaucccucgccgucgucauugcaugcgcaggagcaguaacacgacggggcucggcauacuacauguaccuagacagaaacgacgccggggaggcaaucuccuuccccaccacgcucggcaugaacaaaugcuacauacaaauaauggaccuaggacauaccugcgaugcaacaauguccuacgaaugccccaugcucgacgaaggaguagaaccagacgacgucgacugcuggugcaauacgacaaguacuuggguggucuacggcacaugccaccacaagaaaggcgaagcacgcagaagccgccgcgcgguuacccucccaagccacucaacgcgaaagcuccaaacacgaagccaaacauggcuagaaucccgagaauacacaaagcaccugaucagggucgaaaacuggaucuuccgaaauccaggauucgcacucgcagccgccgcaauagcauggcuacuaggcucuagcacaagccaaaaaguaaucuaccucguaaugauucuccucaucgccccagccuacucaaucagaugcaucggcguaagcaaccgcgacuucgucgaaggaaugucaggcggaacuugggucgacguaguccuagagcacggaggcugcgugacaguaauggcccaagauaagcccacagucgauaucgaauuagucacaaccaccgucuccaauauggcagaaguacgaucguacugcuacgaagcauccauaucagacauggccuccgacucgcgcugccccacccaaggagaagcguaccuagacaaacaauccgacacgcaauacgucugcaaaagaacgcugguagaccgaggcuggggcaacggaugcggccucuucggcaaaggcucacuggucaccugugcaaaguucgccugcuccaagaaaaugacaggcaaaagcauacagccggaaaaccucgaguaccggauaaugcuauccguccacggcagccaacacucagggaugauagucaacgacaccggccacgaaacagacgaaaaccgagccaaggucgaaaucacacccaacucaccccgcgccgaagcaacccugggaggcuucggaucccucgggcucgacugcgagccccgcaccggccuagacuucagcgaccucuacuaccucacaaugaacaacaaacacuggcuaguacacaaggaaugguuccaugacauaccacuccccuggcacgcaggagcggacacaggcaccccacacuggaacaacaaggaagcccugguugaguucaaggacgcgcacgcaaaacgucaaacagucguagugcucggcucccaagaaggagccguccauaccgcccuagccggagcgcucgaggccgaaauggacggagcaaagggacgccuaagcuccggccaccuaaaaugccggcuaaaaauggacaaauuacgccuaaaaggcgucucauacucgcuaugcaccgcagccuucacauucacaaaaauccccgccgaaacacugcacggaacaguaaccgucgaaguacaauacgccggaaccgacggccccugcaaagucccggcacaaauggccgucgacaugcaaacacugacuccagucggcagacucauaaccgcaaacccaguaauaacagaauccacugaaaacucgaaaaugauguuggaauuagacccacccuucggagacagcuacauagucaucggaguaggcgaaaagaaaauaacacaccacuggcacaggagcggcucaacaaucggcaaagccuucgaggcaacugucagaggcgccaaaagaauggccguacuaggcgacaccgcaugggauuucggaaguguaggaggagcccuaaacagccuaggaaaaggcauucaccaaauauucggagccgccuucaagucccuauucggaggcaugucaugguucagccaaauacucauaggaacguuacugauguggcucggccucaacgccaaaaacggaagcaucagccucaugugccucgcgcuaggaggaguccucauauuccugagcaccgcaguaagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11566 - RNA, 2446 nt, Artificial Sequence
  ZIKV (strain MR 766) ME variant mRNA Design 2 opt
ggggcgcugccuacggagguggcagccaucuccuucucggcaucaagcuuaccaugaacgaaggcagcaucauguggcuagcaucgcuggccgucgucaucgcaugcgcaggcgcgaucacccgcaggggaucagcauacuauauguaccuagaccgcagugacgccgguaaggcaaucagcuucgccacgacacucggcguaaacaaaugucacguacaaauaauggaccucggacacaugugcgacgccaccaugaguuacgaaugccccauguuagacgaaggaguagaacccgacgacguagacugcuggugcaacaccaccuccacaugggucgucuacggaaccugccaccacaagaaaggggaagcacgccgaucacggagggcagucacccugcccagccacagcacgcgaaaacugcaaacccgaagccaaaccugguuagaaucacgagaauacaccaaacaccucaucaaaguagaaaacuggauuuuccgaaacccggguuucgcccuaguagcaguagcaaucgcaugguuacucggaagcagcaccagccaaaaagucaucuaucuaguaaugauccuacuaaucgccccggccuacuccauaagaugcaucggagucuccaacagagacuucguagaagggaugucaggcgggacaugggucgacgucguccucgagcacggagggugcgugaccgucauggcccaagacaaacccacagucgacauagaacucgucaccacgacagucagcaacauggcagaagugcgcuccuauugcuaugaagccagcauaagcgacauggccucggacucacgcugcccgacgcagggagaagccuacuuagacaaacaauccgacacccaauacgugugcaaacggacacucgucgaccgcggguggggaaacggaugcggacuguucggaaagggcagccuggucacaugcgccaaguuuaccugcagcaaaaagaugacuggaaaaagcauacagccagaaaaccucgaauaccgcaucaugcuaagcguacacgggagucaacacuccggcaugauaggauacgaaaccgacgaagaccgugccaaaguagaaguaacccccaacagcccccgcgccgaggccacccuaggaggcuucggcagccuaggacucgacugcgagccccgcaccggccuggacuucagcgaccucuacuaccucacaaugaacaacaagcacuggcuaguacacaaggaaugguuccacgacauaccgcuacccuggcacgcaggcgccgacacaggcacaccccacuggaacaacaaggaagcccugguagaguucaaagacgcccacgcaaaacgccaaacaguaguagucuugggcucgcaagaaggagccguacacacagcacuagccggagcacucgaagcagaaauggacggcgcaaaaggccgccuauucagcggccaccucaagugccgacucaaaauggacaaacuccgacuuaaaggagugucguacagccucugcaccgcggccuucaccuucaccaaaguacccgccgaaacacuacacgguacagucaccgucgaaguccaauacgcaggaacagacggaccaugcaaaauucccguccaaauggccgucgacaugcaaacccucaccccuguaggacgacucauaacagcaaacccaguaauaacugaaagcaccgaaaacagcaaaaugaugcuagaacuagacccacccuucggugacaguuauaucguaauaggagucggagacaagaaaaucacacaccacuggcaccgaucaggaucaacaauuggcaaagccuucgaagccacaguaaggggcgcgaaacgcauggccguacucggagacaccgccugggacuucggaucaguaggcggcgucuucaacucccucggaaaaggcauacaccaaauuuucggugccgcguucaagagccucuucggcggaauguccugguucagccaaauacuaaucggaacgcuccuagucuggcucggauuaaacaccaaaaacggaagcauaucccugaccugccucgcacucggaggaguuaugaucuuccucucaaccgcagucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11567 - RNA, 2458 nt, Artificial Sequence
  ZIKV (strain NatalRGN) ME variant mRNA Design 2 opt
ggggcgcugccuacggagguggcagccaucuccuucucggcaucaagcuuaccaugaacgaaggaagcauaauguggcuggcaucgcuagccguaguaauagcaugcgcaggcgcgguaacgcggcgggggucagccuacuacauguaccuagacagaaacgacgccggagaagccaucagcuuccccacaacacuaggaaugaacaaaugcuacauacaaauaauggaccuaggacacaugugcgacgcgacaauguccuacgagugcccgaugcuagacgaaggugucgaacccgacgacgucgacugcuggugcaacaccaccagcacauggguagucuacggcacaugccaccacaagaaaggagaagcacgacgcagccgccgcgcggucacccugccgagccacagcacacgaaaacugcaaacacggucacaaaccuggcuagaaagccgcgaguacacaaagcaccuuaucagaguagaaaacuggaucuuccgcaaucccggauucgcccuggcagcagccgccauagccuggcuacucggcucgagcaccagccaaaagguuaucuaccuagugaugauacuccucaucgcacccgcuuacuccauacguugcaucgggguaucaaaccgagacuucguagaaggcauguccggaggaaccugggucgacguaguucucgaacacggcgguugcgucacggucauggcucaggacaaaccaacagucgacaucgaacucgucaccacaaccgugagcaacauggccgaaguccgcaguuacugcuacgaggcaagcaucagcgacauggcaagcgacagccgaugccccacacaaggagaagcauaccuugacaaacagagcgacacccaauacgucugcaaacgaacauuggucgacagaggcuggggaaacggaugcggacuauucggaaaaggaagccuaguaaccugcgcaaaauucgccugcucaaagaaaaugaccgggaaaagcauacaacccgaaaaccuagaguaccgcauaaugcugagcguccacggcucacaacacuccggcaugauagucaacgacacgggccacgaaacagacgagaacagagccaaaguagaaaucacaccaaacagcccacgcgcagaagcaacccuaggagguuucgggagcuuaggacucgacugugaaccccgaaccggacucgacuucagcgaccuguacuaccucaccaugaacaacaaacacuggcuaguacacaaagaaugguuccacgacauaccacucccauggcacgccggggcagacacagguaccccgcacuggaacaacaaggaagcccuggucgaguucaaagacgcacacgcaaaaagacaaaccgucgugguacuaggaucacaagaaggagcgguccacacagcacucgccggagcgcuugaagcggaaauggacggagcaaaaggccgacucaguagcgggcaccuaaagugccggcuaaaaauggacaaacuccgacuaaaaggagucucauacucgcuaugcaccgccgccuucacguucacaaaaaucccagcugaaacccugcacggcaccguaaccguagagguccaauacgcaggaacugacgggccaugcaaaguacccgcacaaauggcagucgacaugcaaacacuaaccccuguaggccgccucauaacagcaaauccaguaaucaccgaaucaaccgaaaacagcaaaaugauguuagaacucgacccaccguucggcgacagcuacauagucauaggugucggcgagaaaaagaucacccaccacuggcaccgaucgggcucgaccaucggcaaagcauuugaagcuacaguacgaggcgcgaaacgaauggcgguccucggugacacagccugggacuucggaucaguaggcggggcacucaauuccuugggaaaaggaauccaccagaucuucggagcagcauucaaaucccuuuucgggggcaugagcugguucucccaaauacuaauaggcacacugcuaauguggcuaggacucaacaccaaaaacggcagcaucucccugaugugccucgcacuagguggcguacucaucuuccucuccacagcagucuccgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11568 - RNA, 2326 nt, Artificial Sequence
  ZIKV (strain ZikaSPH2015) prME-short variant mRNA Design 3 wild type
gggagaaagcuuaccaugggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11569 - RNA, 2326 nt, Artificial Sequence
  ZIKV (isolate Z1106033) prME-short variant mRNA Design 3 wild type
gggagaaagcuuaccaugggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11570 - RNA, 2314 nt, Artificial Sequence
  ZIKV (strain MR 766) prME-short variant mRNA Design 3 wild type
gggagaaagcuuaccaugggcagaaagcaaaacaaaagaggaggaaaugaaggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11571 - RNA, 2326 nt, Artificial Sequence
  ZIKV (strain NatalRGN) prME-short variant mRNA Design 3 wild type
gggagaaagcuuaccaugggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11572 - RNA, 2299 nt, Artificial Sequence
  ZIKV (strain ZikaSPH2015) prME-short variant mRNA Design 3 wild type
gggagaaagcuuaccaugaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11573 - RNA, 2299 nt, Artificial Sequence
  ZIKV (isolate Z1106033) prME-short variant mRNA Design 3 wild type
gggagaaagcuuaccaugaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11574 - RNA, 2287 nt, Artificial Sequence
  ZIKV (strain MR 766) prME-short variant mRNA Design 3 wild type
gggagaaagcuuaccaugaaugaaggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11575 - RNA, 2299 nt, Artificial Sequence
  ZIKV (strain NatalRGN) prME-short variant mRNA Design 3 wild type
gggagaaagcuuaccaugaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11576 - RNA, 2326 nt, Artificial Sequence
  ZIKV (strain ZikaSPH2015) prME-short variant mRNA Design 3 wild type
gggagaaagcuuaccaugggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11577 - RNA, 2326 nt, Artificial Sequence
  ZIKV (isolate Z1106033) prME-short variant mRNA Design 3 wild type
gggagaaagcuuaccaugggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11578 - RNA, 2314 nt, Artificial Sequence
  ZIKV (strain MR 766) prME-short variant mRNA Design 3 wild type
gggagaaagcuuaccaugggcagaaagcaaaacaaaagaggaggaaaugaaggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11579 - RNA, 2326 nt, Artificial Sequence
  ZIKV (strain NatalRGN) prME-short variant mRNA Design 3 wild type
gggagaaagcuuaccaugggcagaaagcaaaacaaaagaggaggaaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11580 - RNA, 2299 nt, Artificial Sequence
  ZIKV (strain ZikaSPH2015) prME-short variant mRNA Design 3 wild type
gggagaaagcuuaccaugaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11581 - RNA, 2299 nt, Artificial Sequence
  ZIKV (isolate Z1106033) prME-short variant mRNA Design 3 wild type
gggagaaagcuuaccaugaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11582 - RNA, 2287 nt, Artificial Sequence
  ZIKV (strain MR 766) prME-short variant mRNA Design 3 wild type
gggagaaagcuuaccaugaaugaaggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11583 - RNA, 2299 nt, Artificial Sequence
  ZIKV (strain NatalRGN) prME-short variant mRNA Design 3 wild type
gggagaaagcuuaccaugaaugaaggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11584 - RNA, 2326 nt, Artificial Sequence; identical to SEQ ID NO: 11568
  ZIKV (strain ZikaSPH2015) ME variant mRNA Design 3 wild type

SEQ ID NO: 11585 - RNA, 2326 nt, Artificial Sequence; identical to SEQ ID NO: 11569
  ZIKV (isolate Z1106033) ME variant mRNA Design 3 wild type

SEQ ID NO: 11586 - RNA, 2314 nt, Artificial Sequence; identical to SEQ ID NO: 11570
  ZIKV (strain MR 766) ME variant mRNA Design 3 wild type

SEQ ID NO: 11587 - RNA, 2326 nt, Artificial Sequence; identical to SEQ ID NO: 11571
  ZIKV (strain NatalRGN) ME variant mRNA Design 3 wild type

SEQ ID NO: 11588 - RNA, 2299 nt, Artificial Sequence; identical to SEQ ID NO: 11572
  ZIKV (strain ZikaSPH2015) ME variant mRNA Design 3 wild type

SEQ ID NO: 11589 - RNA, 2299 nt, Artificial Sequence; identical to SEQ ID NO: 11573
  ZIKV (isolate Z1106033) ME variant mRNA Design 3 wild type

SEQ ID NO: 11590 - RNA, 2287 nt, Artificial Sequence; identical to SEQ ID NO: 11574
  ZIKV (strain MR 766) ME variant mRNA Design 3 wild type

SEQ ID NO: 11591 - RNA, 2299 nt, Artificial Sequence; identical to SEQ ID NO: 11575
  ZIKV (strain NatalRGN) ME variant mRNA Design 3 wild type

SEQ ID NO: 11592 - RNA, 2326 nt, Artificial Sequence
  ZIKV (strain ZikaSPH2015) prME-short variant mRNA Design 3 opt
gggagaaagcuuaccaugggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11593 - RNA, 2326 nt, Artificial Sequence
  ZIKV (isolate Z1106033) prME-short variant mRNA Design 3 opt
gggagaaagcuuaccaugggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11594 - RNA, 2314 nt, Artificial Sequence
  ZIKV (strain MR 766) prME-short variant mRNA Design 3 opt
gggagaaagcuuaccaugggccggaagcagaacaagcgcgggggcaacgaggggagcaucauguggcuggccucccucgccguggucaucgcgugcgccggcgccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11595 - RNA, 2326 nt, Artificial Sequence
  ZIKV (strain NatalRGN) prME-short variant mRNA Design 3 opt
gggagaaagcuuaccaugggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11596 - RNA, 2299 nt, Artificial Sequence
  ZIKV (strain ZikaSPH2015) prME-short variant mRNA Design 3 opt
gggagaaagcuuaccaugaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11597 - RNA, 2299 nt, Artificial Sequence
  ZIKV (isolate Z1106033) prME-short variant mRNA Design 3 opt
gggagaaagcuuaccaugaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11598 - RNA, 2287 nt, Artificial Sequence
  ZIKV (strain MR 766) prME-short variant mRNA Design 3 opt
gggagaaagcuuaccaugaacgagggcagcaucauguggcuggccucccucgccguggucaucgcgugcgccggggccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11599 - RNA, 2299 nt, Artificial Sequence
  ZIKV (strain NatalRGN) prME-short variant mRNA Design 3 opt
gggagaaagcuuaccaugaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11600 - RNA, 2326 nt, Artificial Sequence
  ZIKV (strain ZikaSPH2015) prME-short variant mRNA Design 3 opt
gggagaaagcuuaccaugggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11601 - RNA, 2326 nt, Artificial Sequence
  ZIKV (isolate Z1106033) prME-short variant mRNA Design 3 opt
gggagaaagcuuaccaugggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11602 - RNA, 2314 nt, Artificial Sequence
  ZIKV (strain MR 766) prME-short variant mRNA Design 3 opt
gggagaaagcuuaccaugggccggaagcagaacaagcgcgggggcaacgaggggagcaucauguggcuggccucccucgccguggucaucgcgugcgccggcgccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11603 - RNA, 2326 nt, Artificial Sequence
  ZIKV (strain NatalRGN) prME-short variant mRNA Design 3 opt
gggagaaagcuuaccaugggccggaagcagaacaagcgcgggggcaacgaggggagcaucauguggcuggccucccucgccguggucaucgcgugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11604 - RNA, 2299 nt, Artificial Sequence
  ZIKV (strain ZikaSPH2015) prME-short variant mRNA Design 3 opt
gggagaaagcuuaccaugaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11605 - RNA, 2299 nt, Artificial Sequence
  ZIKV (isolate Z1106033) prME-short variant mRNA Design 3 opt
gggagaaagcuuaccaugaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11606 - RNA, 2287 nt, Artificial Sequence
  ZIKV (strain MR 766) prME-short variant mRNA Design 3 opt
gggagaaagcuuaccaugaacgagggcagcaucauguggcuggccucccucgccguggucaucgcgugcgccggggccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11607 - RNA, 2299 nt, Artificial Sequence
  ZIKV (strain NatalRGN) prME-short variant mRNA Design 3 opt
gggagaaagcuuaccaugaacgagggcagcaucauguggcuggccucccucgccguggucaucgcgugcgccggggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11608 - RNA, 2326 nt, Artificial Sequence; identical to SEQ ID NO: 11592
  ZIKV (strain ZikaSPH2015) ME variant mRNA Design 3 opt

SEQ ID NO: 11609 - RNA, 2326 nt, Artificial Sequence; identical to SEQ ID NO: 11593
  ZIKV (isolate Z1106033) ME variant mRNA Design 3 opt

SEQ ID NO: 11610 - RNA, 2314 nt, Artificial Sequence; identical to SEQ ID NO: 11594
  ZIKV (strain MR 766) ME variant mRNA Design 3 opt

SEQ ID NO: 11611 - RNA, 2326 nt, Artificial Sequence; identical to SEQ ID NO: 11595
  ZIKV (strain NatalRGN) ME variant mRNA Design 3 opt

SEQ ID NO: 11612 - RNA, 2299 nt, Artificial Sequence; identical to SEQ ID NO: 11596
  ZIKV (strain ZikaSPH2015) ME variant mRNA Design 3 opt

SEQ ID NO: 11613 - RNA, 2299 nt, Artificial Sequence; identical to SEQ ID NO: 11597
  ZIKV (isolate Z1106033) ME variant mRNA Design 3 opt

SEQ ID NO: 11614 - RNA, 2287 nt, Artificial Sequence; identical to SEQ ID NO: 11598
  ZIKV (strain MR 766) ME variant mRNA Design 3 opt

SEQ ID NO: 11615 - RNA, 2299 nt, Artificial Sequence; identical to SEQ ID NO: 11599
  ZIKV (strain NatalRGN) ME variant mRNA Design 3 opt

SEQ ID NO: 11616 - RNA, 2326 nt, Artificial Sequence
  ZIKV (strain ZikaSPH2015) prME-short variant mRNA Design 3 opt
gggagaaagcuuaccaugggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11617 - RNA, 2326 nt, Artificial Sequence
  ZIKV (isolate Z1106033) prME-short variant mRNA Design 3 opt
gggagaaagcuuaccaugggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11618 - RNA, 2314 nt, Artificial Sequence
  ZIKV (strain MR 766) prME-short variant mRNA Design 3 opt
gggagaaagcuuaccaugggccgcaagcagaacaagcgcggcggcaacgagggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11619 - RNA, 2326 nt, Artificial Sequence
  ZIKV (strain NatalRGN) prME-short variant mRNA Design 3 opt
gggagaaagcuuaccaugggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11620 - RNA, 2299 nt, Artificial Sequence
  ZIKV (strain ZikaSPH2015) prME-short variant mRNA Design 3 opt
gggagaaagcuuaccaugaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11621 - RNA, 2299 nt, Artificial Sequence
  ZIKV (isolate Z1106033) prME-short variant mRNA Design 3 opt
gggagaaagcuuaccaugaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11622 - RNA, 2287 nt, Artificial Sequence
  ZIKV (strain MR 766) prME-short variant mRNA Design 3 opt
gggagaaagcuuaccaugaacgagggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11623 - RNA, 2299 nt, Artificial Sequence
  ZIKV (strain NatalRGN) prME-short variant mRNA Design 3 opt
gggagaaagcuuaccaugaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11624 - RNA, 2326 nt, Artificial Sequence
  ZIKV (strain ZikaSPH2015) prME-short variant mRNA Design 3 opt
gggagaaagcuuaccaugggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11625 - RNA, 2326 nt, Artificial Sequence
  ZIKV (isolate Z1106033) prME-short variant mRNA Design 3 opt
gggagaaagcuuaccaugggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11626 - RNA, 2314 nt, Artificial Sequence
  ZIKV (strain MR 766) prME-short variant mRNA Design 3 opt
gggagaaagcuuaccaugggccgcaagcagaacaagcgcggcggcaacgagggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11627 - RNA, 2326 nt, Artificial Sequence
  ZIKV (strain NatalRGN) prME-short variant mRNA Design 3 opt
gggagaaagcuuaccaugggccgcaagcagaacaagcgcggcggcaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11628 - RNA, 2299 nt, Artificial Sequence
  ZIKV (strain ZikaSPH2015) prME-short variant mRNA Design 3 opt
gggagaaagcuuaccaugaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11629 - RNA, 2299 nt, Artificial Sequence
  ZIKV (isolate Z1106033) prME-short variant mRNA Design 3 opt
gggagaaagcuuaccaugaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11630 - RNA, 2287 nt, Artificial Sequence
  ZIKV (strain MR 766) prME-short variant mRNA Design 3 opt
gggagaaagcuuaccaugaacgagggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11631 - RNA, 2299 nt, Artificial Sequence
  ZIKV (strain NatalRGN) prME-short variant mRNA Design 3 opt
gggagaaagcuuaccaugaacgagggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11632 - RNA, 2326 nt, Artificial Sequence; identical to SEQ ID NO: 11616
  ZIKV (strain ZikaSPH2015) ME variant mRNA Design 3 opt

SEQ ID NO: 11633 - RNA, 2326 nt, Artificial Sequence; identical to SEQ ID NO: 11617
  ZIKV (isolate Z1106033) ME variant mRNA Design 3 opt

SEQ ID NO: 11634 - RNA, 2314 nt, Artificial Sequence; identical to SEQ ID NO: 11618
  ZIKV (strain MR 766) ME variant mRNA Design 3 opt

SEQ ID NO: 11635 - RNA, 2326 nt, Artificial Sequence; identical to SEQ ID NO: 11619
  ZIKV (strain NatalRGN) ME variant mRNA Design 3 opt

SEQ ID NO: 11636 - RNA, 2299 nt, Artificial Sequence; identical to SEQ ID NO: 11620
  ZIKV (strain ZikaSPH2015) ME variant mRNA Design 3 opt

SEQ ID NO: 11637 - RNA, 2299 nt, Artificial Sequence; identical to SEQ ID NO: 11621
  ZIKV (isolate Z1106033) ME variant mRNA Design 3 opt

SEQ ID NO: 11638 - RNA, 2287 nt, Artificial Sequence; identical to SEQ ID NO: 11622
  ZIKV (strain MR 766) ME variant mRNA Design 3 opt

SEQ ID NO: 11639 - RNA, 2299 nt, Artificial Sequence; identical to SEQ ID NO: 11623
  ZIKV (strain NatalRGN) ME variant mRNA Design 3 opt

SEQ ID NO: 11640 - RNA, 2326 nt, Artificial Sequence
  ZIKV (strain ZikaSPH2015) prME-short variant mRNA Design 3 opt
gggagaaagcuuaccaugggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacaugugcgaugccacgaugaguuacgaguguccuauguuagacgaagggguggagccagaugacguagauugcugguguaacaccacaagcacuuggguggucuauggaaccugccaucacaaaaagggcgaagcucguagauccaggcgggcagugacacugccgucucauucgacccgcaaacuacagacuagaucacagacauggcucgagagcagggaguacaccaagcaccugauccggguugaaaauuggauuuuucgcaaccccggcuucgcccuugcugccgcggcaaucgccuggcuguuggggaguuccacgucucagaaggugauauaucucgucaugauccugcugauugcuccugccuacagcauccgauguauuggaguguccaauagagacuuuguagaggguaugucaggcgggacuuggguugauaucgugcucgaacauggaggcugcgucaccgugauggcacaagacaaaccaacaguggauauagaguuagucacuaccacaguuaguaacauggcugaggugaggagcuacuguuaugaagccucuauuuccgacauggcgucagauagccggugccccacccagggugaggccuaccuggacaagcagagugacacgcaguauguauguaaacguacucuuguggaucgcggguggggaaauggcugcggcuuguucgggaagggaucucuggucacaugcgcaaaauuugcuuguuccaagaagaugaccgguaaaagcauccaaccugaaaaccuagaguacagaauuaugcucucggugcacggcucucagcacuccgggaugaucguuaaugacacuggacaugaaacagaugagaacagggccaagguggagaucaccccaaauucaccccgggcugaagccacgcugggcgguuucgggagucuuggccuggacugcgagccucgaaccggauuggauuuuagcgaccucuauuaccugacaaugaacaauaaacacugguuaguccauaaggaaugguuccacgauauuccacugccguggcacgcaggcgccgacacugggacaccccauuggaacaacaaagaggcucucguggaauuuaaggaugcgcacgcaaaacgccagaccguaguugugcuuggaucccaggagggugccguccauacugcucuggccggcgcauuggaggccgaaauggacggggcuaagggaagacuaucuagcggccaccugaaguguaggcucaaaauggauaagcugcggcuuaaaggugugucauauagucugugcaccgccgcauucacauuuaccaagauaccugcggagacuuugcaugggacggucacaguggaaguucaauacgcuggcaccgacggaccauguaaagugcccgcccagauggcaguagacaugcagacucucaccccugucggccgccugaucacagccaauccagugauuaccgaguccacugaaaacagcaagaugauguuagagcuggaucccccguucggggacucuuacaucguuauaggagugggugagaagaaaauuacacaccacuggcauagaucaggcaguacgaucgggaaggcuuuugaagccaccgucaggggagcaaaacguauggcugugcuaggcgauacugccugggacuucgguagcguagggggcgcgcucaauucccugggaaagggcauccaccaaauuuucggggccgcuuuuaaaucucuuuucggaggcaugucgugguuuagccagaucuugauugguacacugcucauguggcuggggcuuaacaccaagaauggauccauaucacugaugugcuuggcacucggcggugugcugaucuucuuaaguacagccguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11641 - RNA, 2326 nt, Artificial Sequence
  ZIKV (isolate Z1106033) prME-short variant mRNA Design 3 opt
gggagaaagcuuaccaugggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacacgugcgaugccaccaugaguuacgaguguccuauguuagacgaagggguggagccagaugacguagauugcugguguaacacaacuagcaccuggguggucuauggaacaugccaucacaaaaagggcgaagcucguagauccaggcgggcagugacccugccgucucauucgacucgcaaacuacagacaagaucacagaccuggcucgagagcagggaguacacgaagcaccugauccggguugaaaauuggauuuuucgcaaccccggcuucgcccuugcugccgcggcaaucgccuggcuguuggggaguuccacuucucagaaggugauauaucucgucaugauccugcugauugcuccugccuacagcauccgauguauuggaguguccaauagagacuuuguagaggguaugucaggcgggaccuggguugaugugguccucgaacauggaggcugcgugacagugauggcacaagacaaaccaacugucgauaucgaguuaguuaccacaaccgugaguaacauggcugagguaaggagcuacuguuaugaagccucuauauccgacauggcgucagauagccggugccccacgcagggugaggccuaccuggacaagcagagugacacucaguauguguguaaacguacacuugucgaucgcggguggggaaauggcugcggcuuguucgggaagggaucucuggugaccugcgcaaaauuugcuuguuccaagaagaugacugguaaaagcauucaaccugaaaaccuagaguacagaaucaugcucucgguucacggcucucagcacuccgggaugauugugaaugacacaggacaugaaaccgaugagaacagggccaaggucgagaucacgccaaauucaccccgggcugaagccacccugggcgguuucgggagucuuggccuggacugcgagccucgaacaggauuggauuuuagcgaccucuauuaccugacuaugaacaauaaacacugguuagugcauaaggaaugguuccacgauaucccacugccguggcacgcaggcgccgacaccgggacaccccauuggaacaacaaagaggcucucguagaauuuaaggaugcgcacgcaaaacgccagacuguugugguccuuggaucccaggagggugccgugcauaccgcucuggccggcgcauuggaggccgaaauggacggggcuaagggaagacuaucuagcggccaccugaaguguaggcucaaaauggauaagcugcggcuuaaaggugucucauauagucugugcacagccgcauucaccuuuacuaagauuccugcggagacguugcaugggacagugaccguugaagugcaauacgcuggcacugacggaccauguaaaguacccgcccagauggcagucgacaugcagacccucacaccugugggccgccugauaaccgccaauccaguuaucacugaguccacagaaaacagcaagaugauguuagagcuggaucccccguucggggacucuuacauugugaucggagucggugagaagaaaauaacgcaccacuggcauagaucaggcaguaccauugggaaggcuuuugaagccacugugaggggagcaaaacguauggcuguacuaggcgauacagccugggacuucgguagcguugggggcgcgcucaauucccugggaaagggcauccaccaaaucuucggggccgcuuuuaaaucucuuuucggaggcaugucgugguuuagccagauuuugaucgguacccugcucauguggcuggggcuuaacgcaaagaauggauccauuucacugaugugcuuggcccucggcggugugcugauauucuuaaguacagcugucucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11642 - RNA, 2314 nt, Artificial Sequence
  ZIKV (strain MR 766) prME-short variant mRNA Design 3 opt
gggagaaagcuuaccaugggcagaaagcagaacaaaaggggagggaaugaggguagcaucauguggcuggccucccucgcuguggucauugcaugcgccggcgcgauaacccggcgcgggucugcuuacuauauguaccuugaccgaucagaugccggaaaggcaaucaguuucgccacaacucugggcguuaacaaaugucacgugcaaauuauggacuugggucauaugugcgaugcuacgaugagcuaugaaugucccauguuagacgaggggguagaaccugaugacguggauugcugguguaauaccacauccacuugggucguguacggaaccugccaccauaagaaaggcgaggcacguagaucuaggcgggccguuacacugccaucgcacucaacccgcaagcuacagacuagaagccagacauggcucgaaaguagggaguauaccaagcaucugaucaaaguggagaacuggauuuuucggaauccgggcuucgcucuugucgccguggcgaucgcauggcuguugggguccucuacgagccagaagguaauauaccucguuaugauccugcugauugcccccgcuuauuccauccgcuguauuggagugucaaaccgagacuuugucgaagguaugaguggcgggacuuggguggaugugguccucgagcacggaggcugcguuaccgugauggcccaagacaaaccuacaguagauaucgaauuagugacuaccacagucagcaauauggcagaggugagaucuuacuguuacgaggcuuccauaucagacauggccagcgauaguaggugcccaacccagggugaagcguaucuggacaagcagucugacacgcaguacguuuguaaacggacucuuguggaucguggguggggaaacggcugcggcuuguucgggaagggaucccuggucacaugcgccaaguuuaccuguagcaaaaagaugacugguaaaucgauucaacccgagaaucuagaauaucgcaucaugcucucugugcacggcucccagcauucagggaugauuggauacgagacagacgaagauagagcaaagguagagguuaccccuaacaguccaagggcugaggccacgcugggcgguuucgggagccuuggccuggacugcgaaccccggaccggauuggauuuuuccgaccucuauuaccugacaaugaauaacaaacacugguuagugcauaaggagugguuccacgauaucccucugccauggcacgcuggcgccgacacugggaccccgcauuggaauaacaaagaagcacucgucgaguuuaaggaugcccacgcuaagcgacagacaguggucgugcuuggaucucaggaaggugcgguucauacugcacuggccggcgcuuuggaggccgagauggacggggcaaaaggacgccuauucagcggccaccugaaguguagacucaaaauggauaagcugaggcuuaaaggugugucauauagucugugcaccgccgcuuuuacauucaccaagguacccgccgaaacuuugcaugggacggucacaguggagguucaauacgcaggcaccgacggaccuuguaagaucccagugcagauggcggucgacaugcagacucucacccccgugggccggcugauuacagcuaauccuguaauaaccgaauccacugagaacagcaaaaugauguuagaacuggauccacccuuuggggacucuuacaucgugauuggaguuggugauaagaaaaucacacaccacuggcaucgcucaggcaguacgauagggaaggccuucgaggcaaccgucagaggagccaaaaggauggcugugcuaggcgacacugccugggauuucgguagcgucgggggcguguuuaacucccucggaaagggcauucaccaaaucuucggggcagcuuuuaagucucuguucggaggcaugucgugguuuagccagauccuuauugguacauugcugguuuggcucgggcugaauaccaaaaacggauccaucucacuuacaugccuggccuugggcggugugaugauuuuccucaguacugcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11643 - RNA, 2326 nt, Artificial Sequence
  ZIKV (strain NatalRGN) prME-short variant mRNA Design 3 opt
gggagaaagcuuaccaugggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacaugugcgaugccacgaugaguuacgaguguccuauguuagacgaagggguggagccagaugacguagauugcugguguaacaccacaagcacuuggguggucuauggaaccugccaucacaaaaagggcgaagcucguagauccaggcgggcagugacacugccgucucauucgacccgcaaacuacagacuagaucacagacauggcucgagagcagggaguacaccaagcaccugauccggguugaaaauuggauuuuucgcaaccccggcuucgcccuugcugccgcggcaaucgccuggcuguuggggaguuccacgucucagaaggugauauaucucgucaugauccugcugauugcuccugccuacagcauccgauguauuggaguguccaauagagacuuuguagaggguaugucaggcgggacuuggguugaugugguccucgaacauggaggcugcgugaccgugauggcacaagacaaaccaacagucgauaucgaguuaguuacuaccacagugaguaacauggcugagguaaggagcuacuguuaugaagccucuauauccgacauggcgucagauagccggugccccacccagggugaggccuaccuggacaagcagagugacacgcaguauguguguaaacguacucuugucgaucgcggguggggaaauggcugcggcuuguucgggaagggaucucuggugacaugcgcaaaauuugcuuguuccaagaagaugaccgguaaaagcauucaaccugaaaaccuagaguacagaaucaugcucucgguucacggcucucagcacuccgggaugauugugaaugacacuggacaugaaacagaugagaacagggccaaggucgagaucaccccaaauucaccccgggcugaagccacgcugggcgguuucgggagucuuggccuggacugcgagccucgaaccggauuggauuuuagcgaccucuauuaccugacaaugaacaauaaacacugguuagugcauaaggaaugguuccacgauaucccacugccguggcacgcaggcgccgacacugggacaccccauuggaacaacaaagaggcucucguagaauuuaaggaugcgcacgcaaaacgccagaccguugugguccuuggaucccaggagggugccgugcauacugcucuggccggcgcauuggaggccgaaauggacggggcuaagggaagacuaucuagcggccaccugaaguguaggcucaaaauggauaagcugcggcuuaaaggugucucauauagucugugcaccgccgcauucacauuuaccaagauuccugcggagacuuugcaugggacggugacaguugaagugcaauacgcuggcaccgacggaccauguaaaguacccgcccagauggcagucgacaugcagacucucaccccugugggccgccugauaacagccaauccaguuaucaccgaguccacugaaaacagcaagaugauguuagagcuggaucccccguucggggacucuuacauugugaucggagucggugagaagaaaauaacacaccacuggcauagaucaggcaguacgauugggaaggcuuuugaagccaccgugaggggagcaaaacguauggcuguacuaggcgauacugccugggacuucgguagcguugggggcgcgcucaauucccugggaaagggcauccaccaaaucuucggggccgcuuuuaaaucucuuuucggaggcaugucgugguuuagccagauuuugaucgguacacugcucauguggcuggggcuuaacaccaagaauggauccauuucacugaugugcuuggcacucggcggugugcugauauucuuaaguacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11644 - RNA, 2299 nt, Artificial Sequence
  ZIKV (strain ZikaSPH2015) prME-short variant mRNA Design 3 opt
gggagaaagcuuaccaugaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacaugugcgaugccacgaugaguuacgaguguccuauguuagacgaaggaguggagccagaugacguagauugcugguguaauaccacaagcacuuggguggucuaugguaccugccaucacaaaaagggcgaagcucgccgaucccguagagcagugacacugccgucucauucgaccaggaaacuacaaacucggucacagacauggcucgagagccgcgaguacaccaagcaccugaucagaguugaaaacuggauuuuuaggaaucccggguucgcccuugcugccgcggcaaucgccuggcuguugggaaguuccacgucucagaaagugauauaucucgucaugauccugcugauugcuccugccuacagcauccgguguauuggcguguccaaccgcgacuuuguagagggcaugucagggggaacuuggguugauaucgugcucgaacaugguggcugcgucaccgugauggcacaggacaagccaacaguggauauagaguuagucacuaccacaguuaguaauauggcugaggugcgaagcuacuguuaugaagccucuauuuccgacauggcgucagauagcagaugccccacccaaggggaggccuaccuggacaagcagagugacacgcaguauguauguaaaaggacucuuguggaucggggauggggcaacgguugcggguuguucggaaagggcucucuggucacaugcgcaaaauuugcuuguuccaagaaaaugaccggcaagagcauccagccugaaaaucuagaguaccguauuaugcucucggugcacgggucucaacacuccggaaugaucguuaacgacacuggucaugaaacagaugagaaucgcgccaagguggagaucaccccaaacucacccagagcugaagccacgcugggcggguucggaagucuuggccuggacugcgagccuaggaccgguuuggauuuuagcgaccucuauuaccugacaaugaauaacaaacacugguuaguccauaaggaaugguuccacgauauuccacugccguggcacgcaggggccgacacuggcacaccccauuggaauaacaaagaggcucucguggaauuuaaggaugcgcacgcaaaacggcagaccguaguugugcuuggaucccaggagggcgccguccauacugcucuggccggggcauuggaggccgaaauggacggagcuaagggucgacuaucuagcggccaccugaaaugucgccucaagauggauaagcugagacuuaaaggggugucauauagucugugcaccgccgcauucacauuuaccaagauaccugcggagacuuugcauggaacggucacaguggaaguucaguacgcuggcaccgacgguccauguaaagugcccgcccaaauggcaguagacaugcagacucucaccccugucgggaggcugaucacagccaacccagugauuaccgaguccacugaaaauagcaagaugauguuagagcuggaucccccguucggcgacucuuacaucguuauaggagugggcgagaaaaagauuacacaccacuggcaucggucagggaguacgaucggaaaggcuuuugaagccaccguccgcggugcaaaaagaauggcugugcuaggcgauacugccugggacuucgggagcguaggaggcgcgcucaacucccuggguaaggggauccaccagauuuucggcgccgcuuuuaaaucucuuuucggaggcaugucgugguuuagccaaaucuugauugggacacugcucauguggcugggacuuaauaccaagaacggcuccauaucacugaugugcuuggcacucgguggggugcugaucuucuuaaguacagccguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11645 - RNA, 2299 nt, Artificial Sequence
  ZIKV (isolate Z1106033) prME-short variant mRNA Design 3 opt
gggagaaagcuuaccaugaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacacgugcgaugccaccaugaguuacgaguguccuauguuagacgaaggaguggagccagaugacguagauugcugguguaauacaacuagcaccuggguggucuauggcacaugccaucacaaaaagggugaagcucgccgaucccguagagcagugacccugccgucucauucgacuaggaaacuacaaacacggucacagaccuggcucgagagccgcgaguacacgaagcaccugaucagaguugaaaacuggauuuuuaggaaucccggguucgcccuugcugccgcggcaaucgccuggcuguugggaaguuccacuucucagaaagugauauaucucgucaugauccugcugauugcuccugccuacagcauccgguguauuggcguguccaaccgcgacuuuguagagggcaugucagggggaaccuggguugaugugguccucgaacaugguggcugcgugacagugauggcacaggacaagccaacugucgauaucgaguuaguuaccacaaccgugaguaauauggcugagguacgaagcuacuguuaugaagccucuauauccgacauggcgucagauagcagaugccccacgcaaggggaggccuaccuggacaagcagagugacacucaguauguguguaaaaggacacuugucgaucggggauggggcaacgguugcggguuguucggaaagggcucucuggugaccugcgcaaaauuugcuuguuccaagaaaaugacuggcaagagcauucagccugaaaaucuagaguaccguaucaugcucucgguucacgggucucaacacuccggaaugauugugaacgacacaggucaugaaaccgaugagaaucgcgccaaggucgagaucacgccaaacucacccagagcugaagccacccugggcggguucggaagucuuggccuggacugcgagccuaggacagguuuggauuuuagcgaccucuauuaccugacuaugaauaacaaacacugguuagugcauaaggaaugguuccacgauaucccacugccguggcacgcaggggccgacaccggcacaccccauuggaauaacaaagaggcucucguagaauuuaaggaugcgcacgcaaaacggcagacuguugugguccuuggaucccaggagggcgccgugcauaccgcucuggccggggcauuggaggccgaaauggacggagcuaagggucgacuaucuagcggccaccugaaaugucgccucaagauggauaagcugagacuuaaaggggucucauauagucugugcacagccgcauucaccuuuacuaagauuccugcggagacguugcauggaacagugaccguugaagugcaguacgcuggcacugacgguccauguaaaguacccgcccaaauggcagucgacaugcagacccucacaccuguggggaggcugauaaccgccaacccaguuaucacugaguccacagaaaauagcaagaugauguuagagcuggaucccccguucggcgacucuuacauugugaucggagucggcgagaaaaagauaacgcaccacuggcaucggucagggaguaccauuggaaaggcuuuugaagccacugugcgcggugcaaaaagaauggcuguacuaggcgauacagccugggacuucgggagcgugggaggcgcgcucaacucccuggguaaggggauccaccagaucuucggcgccgcuuuuaaaucucuuuucggaggcaugucgugguuuagccaaauuuugaucgggacccugcucauguggcugggacuuaaugcaaagaacggcuccauuucacugaugugcuuggcccucggugggguucugauauucuuaaguacagcugucucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11646 - RNA, 2287 nt, Artificial Sequence
  ZIKV (strain MR 766) prME-short variant mRNA Design 3 opt
gggagaaagcuuaccaugaacgagggcagcaucauguggcuggccucccucgcuguggucauugcaugcgccggggcgauaaccagaaggggaucugcuuacuauauguaccuugaccggucagaugccgguaaggcaaucaguuucgccacaacucugggcguuaauaaaugucacgugcagauuauggacuuggggcauaugugcgaugcuacgaugagcuaugaaugucccauguuagacgagggaguagaaccugaugacguggauugcugguguaacaccacauccacuugggucguguacgguaccugccaccauaagaaaggcgaggcacgccgaucucguagagccguuacacugccaucgcacucaaccaggaagcuacaaacucggagccagacauggcucgaaagucgcgaguauaccaaacaucugaucaagguggagaauuggauuuuuagaaacccgggguucgcucuugucgccguggcgaucgcauggcuguugggauccucuacgagccagaagguaauauaccucguuaugauccugcugauugcccccgcuuauuccaucagguguauuggcgugucaaaucgggacuuugucgaaggcaugagugggggaacuuggguggaugugguccucgagcacgguggcugcguuaccgugauggcccaggacaaaccuacaguagauaucgaauuagugacuaccacagucagcaacauggcagaggugcgcucuuacuguuacgaggcuuccauaucagacauggccagcgauagucgaugcccaacccaaggggaagcguaucuggacaagcagucugacacgcaguacguuuguaaaagaacucuuguggauaggggauggggcaaugguugcggguuguucggaaagggcucccuggucacaugcgccaaauuuaccuguagcaagaagaugacuggcaaaucgauucagcccgagaaccuagaauaucggaucaugcucucugugcacgggucccaacauucaggaaugauugguuacgagacagacgaagaucgugcaaagguagagguuaccccuaauaguccacgcgcugaggccacgcugggcggguucggaagccuuggccuggacugcgaacccagaaccgguuuggauuuuuccgaccucuauuaccugacaaugaacaauaaacacugguuagugcauaaggagugguuccacgauaucccucugccauggcacgcuggggccgacacuggcaccccgcauuggaacaauaaagaagcacucgucgaguuuaaggaugcccacgcuaaaaggcagacaguggucgugcuuggaucucaggaaggcgcgguucauacugcacuggccggggcuuuggaggccgagauggacggagcaaagggucggcuauucagcggccaccugaagugucgacucaaaauggauaagcugcgccuuaaaggggugucauauagucugugcaccgccgcuuuuacauucaccaagguacccgccgaaacuuugcauggaacggucacaguggagguucaguacgcaggcaccgacgguccuuguaaaaucccagugcaaauggcggucgacaugcagacucucacccccguggggagacugauuacagcuaacccuguaauaaccgaauccacugagaauagcaagaugauguuagaacuggauccacccuuuggcgacucuuacaucgugauuggaguuggcgauaagaaaaucacacaccacuggcauaggucagggaguacgauaggaaaggccuucgaggcaaccguccggggugccaaacgcauggcugugcuaggcgacacugccugggauuucgggagcgugggaggcgucuuuaacucccucgguaaggggauucaccagaucuucggcgcagcuuuuaaaucucuguucggaggcaugucgugguuuagccaaauccuuauugggacauugcugguuuggcucggacugaacaccaagaauggcuccaucucacuuacaugccuggccuuggguggggugaugauuuuccucaguacugcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11647 - RNA, 2299 nt, Artificial Sequence
  ZIKV (strain NatalRGN) prME-short variant mRNA Design 3 opt
gggagaaagcuuaccaugaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacaugugcgaugccacgaugaguuacgaguguccuauguuagacgaaggaguggagccagaugacguagauugcugguguaauaccacaagcacuuggguggucuaugguaccugccaucacaaaaagggcgaagcucgccgaucccguagagcagugacacugccgucucauucgaccaggaaacuacaaacucggucacagacauggcucgagagccgcgaguacaccaagcaccugaucagaguugaaaacuggauuuuuaggaaucccggguucgcccuugcugccgcggcaaucgccuggcuguugggaaguuccacgucucagaaagugauauaucucgucaugauccugcugauugcuccugccuacagcauccgguguauuggcguguccaaccgcgacuuuguagagggcaugucagggggaacuuggguugaugugguccucgaacaugguggcugcgugaccgugauggcacaggacaagccaacagucgauaucgaguuaguuacuaccacagugaguaauauggcugagguacgaagcuacuguuaugaagccucuauauccgacauggcgucagauagcagaugccccacccaaggggaggccuaccuggacaagcagagugacacgcaguauguguguaaaaggacucuugucgaucggggauggggcaacgguugcggguuguucggaaagggcucucuggugacaugcgcaaaauuugcuuguuccaagaaaaugaccggcaagagcauucagccugaaaaucuagaguaccguaucaugcucucgguucacgggucucaacacuccggaaugauugugaacgacacuggucaugaaacagaugagaaucgcgccaaggucgagaucaccccaaacucacccagagcugaagccacgcugggcggguucggaagucuuggccuggacugcgagccuaggaccgguuuggauuuuagcgaccucuauuaccugacaaugaauaacaaacacugguuagugcauaaggaaugguuccacgauaucccacugccguggcacgcaggggccgacacuggcacaccccauuggaauaacaaagaggcucucguagaauuuaaggaugcgcacgcaaaacggcagaccguugugguccuuggaucccaggagggcgccgugcauacugcucuggccggggcauuggaggccgaaauggacggagcuaagggucgacuaucuagcggccaccugaaaugucgccucaagauggauaagcugagacuuaaaggggucucauauagucugugcaccgccgcauucacauuuaccaagauuccugcggagacuuugcauggaacggugacaguugaagugcaguacgcuggcaccgacgguccauguaaaguacccgcccaaauggcagucgacaugcagacucucaccccuguggggaggcugauaacagccaacccaguuaucaccgaguccacugaaaauagcaagaugauguuagagcuggaucccccguucggcgacucuuacauugugaucggagucggcgagaaaaagauaacacaccacuggcaucggucagggaguacgauuggaaaggcuuuugaagccaccgugcgcggugcaaaaagaauggcuguacuaggcgauacugccugggacuucgggagcgugggaggcgcgcucaacucccuggguaaggggauccaccagaucuucggcgccgcuuuuaaaucucuuuucggaggcaugucgugguuuagccaaauuuugaucgggacacugcucauguggcugggacuuaauaccaagaacggcuccauuucacugaugugcuuggcacucggugggguucugauauucuuaaguacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11648 - RNA, 2326 nt, Artificial Sequence
  ZIKV (strain ZikaSPH2015) prME-short variant mRNA Design 3 opt
gggagaaagcuuaccaugggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacaugugcgaugccacgaugaguuacgaguguccuauguuagacgaagggguggagccagaugacguagauugcugguguaacaccacaagcacuuggguggucuauggaaccugccaucacaaaaagggcgaagcucguagauccaggcgggcagugacacugccgucucauucgacccgcaaacuacagacuagaucacagacauggcucgagagcagggaguacaccaagcaccugauccggguugaaaauuggauuuuucgcaaccccggcuucgcccuugcugccgcggcaaucgccuggcuguuggggaguuccacgucucagaaggugauauaucucgucaugauccugcugauugcuccugccuacagcauccgauguauuggaguguccaauagagacuuuguagaggguaugucaggcgggacuuggguugauaucgugcucgaacauggaggcugcgucaccgugauggcacaagacaaaccaacaguggauauagaguuagucacuaccacaguuaguaacauggcugaggugaggagcuacuguuaugaagccucuauuuccgacauggcgucagauagccggugccccacccagggugaggccuaccuggacaagcagagugacacgcaguauguauguaaacguacucuuguggaucgcggguggggaaauggcugcggcuuguucgggaagggaucucuggucacaugcgcaaaauuugcuuguuccaagaagaugaccgguaaaagcauccaaccugaaaaccuagaguacagaauuaugcucucggugcacggcucucagcacuccgggaugaucguuaaugacacuggacaugaaacagaugagaacagggccaagguggagaucaccccaaauucaccccgggcugaagccacgcugggcgguuucgggagucuuggccuggacugcgagccucgaaccggauuggauuuuagcgaccucuauuaccugacaaugaacaauaaacacugguuaguccauaaggaaugguuccacgauauuccacugccguggcacgcaggcgccgacacugggacaccccauuggaacaacaaagaggcucucguggaauuuaaggaugcgcacgcaaaacgccagaccguaguugugcuuggaucccaggagggugccguccauacugcucuggccggcgcauuggaggccgaaauggacggggcuaagggaagacuaucuagcggccaccugaaguguaggcucaaaauggauaagcugcggcuuaaaggugugucauauagucugugcaccgccgcauucacauuuaccaagauaccugcggagacuuugcaugggacggucacaguggaaguucaauacgcuggcaccgacggaccauguaaagugcccgcccagauggcaguagacaugcagacucucaccccugucggccgccugaucacagccaauccagugauuaccgaguccacugaaaacagcaagaugauguuagagcuggaucccccguucggggacucuuacaucguuauaggagugggugagaagaaaauuacacaccacuggcauagaucaggcaguacgcuagggaaggcuuuuagcaccacucucaaaggagcccaaaggcuggcagcucuuggcgauacagccugggacuucgguuccaucgggggcgucuucaauucuaucggacgugcggugcaccagguauuuggcggggccuuccggaccuuguuuggaggcaugucguggauuacacagggucugaugggggcucuccugcuuuggaugggagugaacgcacgagauagaagcaucgcccuggcuuucuuggccacuggcgguguucucgucuuucuggcaaccaaugugcaugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11649 - RNA, 2326 nt, Artificial Sequence
  ZIKV (isolate Z1106033) prME-short variant mRNA Design 3 opt
gggagaaagcuuaccaugggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacacgugcgaugccaccaugaguuacgaguguccuauguuagacgaagggguggagccagaugacguagauugcugguguaacacaacuagcaccuggguggucuauggaacaugccaucacaaaaagggcgaagcucguagauccaggcgggcagugacccugccgucucauucgacucgcaaacuacagacaagaucacagaccuggcucgagagcagggaguacacgaagcaccugauccggguugaaaauuggauuuuucgcaaccccggcuucgcccuugcugccgcggcaaucgccuggcuguuggggaguuccacuucucagaaggugauauaucucgucaugauccugcugauugcuccugccuacagcauccgauguauuggaguguccaauagagacuuuguagaggguaugucaggcgggaccuggguugaugugguccucgaacauggaggcugcgugacagugauggcacaagacaaaccaacugucgauaucgaguuaguuaccacaaccgugaguaacauggcugagguaaggagcuacuguuaugaagccucuauauccgacauggcgucagauagccggugccccacgcagggugaggccuaccuggacaagcagagugacacucaguauguguguaaacguacacuugucgaucgcggguggggaaauggcugcggcuuguucgggaagggaucucuggugaccugcgcaaaauuugcuuguuccaagaagaugacugguaaaagcauucaaccugaaaaccuagaguacagaaucaugcucucgguucacggcucucagcacuccgggaugauugugaaugacacaggacaugaaaccgaugagaacagggccaaggucgagaucacgccaaauucaccccgggcugaagccacccugggcgguuucgggagucuuggccuggacugcgagccucgaacaggauuggauuuuagcgaccucuauuaccugacuaugaacaauaaacacugguuagugcauaaggaaugguuccacgauaucccacugccguggcacgcaggcgccgacaccgggacaccccauuggaacaacaaagaggcucucguagaauuuaaggaugcgcacgcaaaacgccagacuguugugguccuuggaucccaggagggugccgugcauaccgcucuggccggcgcauuggaggccgaaauggacggggcuaagggaagacuaucuagcggccaccugaaguguaggcucaaaauggauaagcugcggcuuaaaggugucucauauagucugugcacagccgcauucaccuuuacuaagauuccugcggagacguugcaugggacagugaccguugaagugcaauacgcuggcacugacggaccauguaaaguacccgcccagauggcagucgacaugcagacccucacaccugugggccgccugauaaccgccaauccaguuaucacugaguccacagaaaacagcaagaugauguuagagcuggaucccccguucggggacucuuacauugugaucggagucggugagaagaaaauaacgcaccacuggcauagaucaggcaguacccuagggaaggcuuuuagcacuacacucaaaggagcccaaaggcuggcagcucuuggcgauaccgccugggacuucgguuccauugggggcguguucaauucuaucggacgugcgguacaccagguguuuggcggggccuuccggacauuguuuggaggcaugucguggaucacucagggucugaugggggcucuccugcuuuggaugggaguuaacgcacgagauagaagcauugcccuggcuuucuuggccaccggcgguguccucguguuucuggcaacgaaugugcaugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11650 - RNA, 2314 nt, Artificial Sequence
  ZIKV (strain MR 766) prME-short variant mRNA Design 3 opt
gggagaaagcuuaccaugggcagaaagcagaacaaaaggggagggaaugaggguagcaucauguggcuggccucccucgcuguggucauugcaugcgccggcgcgauaacccggcgcgggucugcuuacuauauguaccuugaccgaucagaugccggaaaggcaaucaguuucgccacaacucugggcguuaacaaaugucacgugcaaauuauggacuugggucauaugugcgaugcuacgaugagcuaugaaugucccauguuagacgaggggguagaaccugaugacguggauugcugguguaauaccacauccacuugggucguguacggaaccugccaccauaagaaaggcgaggcacguagaucuaggcgggccguuacacugccaucgcacucaacccgcaagcuacagacuagaagccagacauggcucgaaaguagggaguauaccaagcaucugaucaaaguggagaacuggauuuuucggaauccgggcuucgcucuugucgccguggcgaucgcauggcuguugggguccucuacgagccagaagguaauauaccucguuaugauccugcugauugcccccgcuuauuccauccgcuguauuggagugucaaaccgagacuuugucgaagguaugaguggcgggacuuggguggaugugguccucgagcacggaggcugcguuaccgugauggcccaagacaaaccuacaguagauaucgaauuagugacuaccacagucagcaauauggcagaggugagaucuuacuguuacgaggcuuccauaucagacauggccagcgauaguaggugcccaacccagggugaagcguaucuggacaagcagucugacacgcaguacguuuguaaacggacucuuguggaucguggguggggaaacggcugcggcuuguucgggaagggaucccuggucacaugcgccaaguuuaccuguagcaaaaagaugacugguaaaucgauucaacccgagaaucuagaauaucgcaucaugcucucugugcacggcucccagcauucagggaugauuggauacgagacagacgaagauagagcaaagguagagguuaccccuaacaguccaagggcugaggccacgcugggcgguuucgggagccuuggccuggacugcgaaccccggaccggauuggauuuuuccgaccucuauuaccugacaaugaauaacaaacacugguuagugcauaaggagugguuccacgauaucccucugccauggcacgcuggcgccgacacugggaccccgcauuggaauaacaaagaagcacucgucgaguuuaaggaugcccacgcuaagcgacagacaguggucgugcuuggaucucaggaaggugcgguucauacugcacuggccggcgcuuuggaggccgagauggacggggcaaaaggacgccuauucagcggccaccugaaguguagacucaaaauggauaagcugaggcuuaaaggugugucauauagucugugcaccgccgcuuuuacauucaccaagguacccgccgaaacuuugcaugggacggucacaguggagguucaauacgcaggcaccgacggaccuuguaagaucccagugcagauggcggucgacaugcagacucucacccccgugggccggcugauuacagcuaauccuguaauaaccgaauccacugagaacagcaaaaugauguuagaacuggauccacccuuuggggacucuuacaucgugauuggaguuggugauaagaaaaucacacaccacuggcaucgcucaggcaguacgcuagggaaggccuucagcaccacucucaaaggagcacaaagacuggccgcucuuggcgacacagccugggauuucgguuccauagggggcgucuuuaacucuauuggaagggcagugcaccagguguucggcggggcuuuucguaccuuguucggaggcaugucguggaucacacagggucugaugggggcccuccugcuuuggaugggagucaaugcgcgggaccgaagcaucgcccuggcauuuuuggcuacuggcgguguucucguguuccuggccaccaacgugcaugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11651 - RNA, 2326 nt, Artificial Sequence
  ZIKV (strain NatalRGN) prME-short variant mRNA Design 3 opt
gggagaaagcuuaccaugggcagaaagcagaacaaaaggggagggaaugaggguagcaucauguggcuggccucccucgcuguggucauugcaugcgccggcgcgguuacccggcgcgggucugcuuacuauauguaccuugaccgaaacgaugccggagaagcaauaucauuccccacaacucugggcaugaauaaguguuauauccaaauuauggacuugggucacaugugcgaugccacgaugaguuacgaguguccuauguuagacgaagggguggagccagaugacguagauugcugguguaacaccacaagcacuuggguggucuauggaaccugccaucacaaaaagggcgaagcucguagauccaggcgggcagugacacugccgucucauucgacccgcaaacuacagacuagaucacagacauggcucgagagcagggaguacaccaagcaccugauccggguugaaaauuggauuuuucgcaaccccggcuucgcccuugcugccgcggcaaucgccuggcuguuggggaguuccacgucucagaaggugauauaucucgucaugauccugcugauugcuccugccuacagcauccgauguauuggaguguccaauagagacuuuguagaggguaugucaggcgggacuuggguugaugugguccucgaacauggaggcugcgugaccgugauggcacaagacaaaccaacagucgauaucgaguuaguuacuaccacagugaguaacauggcugagguaaggagcuacuguuaugaagccucuauauccgacauggcgucagauagccggugccccacccagggugaggccuaccuggacaagcagagugacacgcaguauguguguaaacguacucuugucgaucgcggguggggaaauggcugcggcuuguucgggaagggaucucuggugacaugcgcaaaauuugcuuguuccaagaagaugaccgguaaaagcauucaaccugaaaaccuagaguacagaaucaugcucucgguucacggcucucagcacuccgggaugauugugaaugacacuggacaugaaacagaugagaacagggccaaggucgagaucaccccaaauucaccccgggcugaagccacgcugggcgguuucgggagucuuggccuggacugcgagccucgaaccggauuggauuuuagcgaccucuauuaccugacaaugaacaauaaacacugguuagugcauaaggaaugguuccacgauaucccacugccguggcacgcaggcgccgacacugggacaccccauuggaacaacaaagaggcucucguagaauuuaaggaugcgcacgcaaaacgccagaccguugugguccuuggaucccaggagggugccgugcauacugcucuggccggcgcauuggaggccgaaauggacggggcuaagggaagacuaucuagcggccaccugaaguguaggcucaaaauggauaagcugcggcuuaaaggugucucauauagucugugcaccgccgcauucacauuuaccaagauuccugcggagacuuugcaugggacggugacaguugaagugcaauacgcuggcaccgacggaccauguaaaguacccgcccagauggcagucgacaugcagacucucaccccugugggccgccugauaacagccaauccaguuaucaccgaguccacugaaaacagcaagaugauguuagagcuggaucccccguucggggacucuuacauugugaucggagucggugagaagaaaauaacacaccacuggcauagaucaggcaguacgcuagggaaggcuuuuagcaccacucucaaaggagcccaaaggcuggcagcucuuggcgauacagccugggacuucgguuccauugggggcguguucaauucuaucggacgugcgguacaccagguguuuggcggggccuuccggaccuuguuuggaggcaugucguggaucacacagggucugaugggggcucuccugcuuuggaugggaguuaacgcacgagauagaagcauugcccuggcuuucuuggccacuggcgguguccucguguuucuggcaaccaaugugcaugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11652 - RNA, 2299 nt, Artificial Sequence
  ZIKV (strain ZikaSPH2015) prME-short variant mRNA Design 3 opt
gggagaaagcuuaccaugaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacaugugcgaugccacgaugaguuacgaguguccuauguuagacgaaggaguggagccagaugacguagauugcugguguaauaccacaagcacuuggguggucuaugguaccugccaucacaaaaagggcgaagcucgccgaucccguagagcagugacacugccgucucauucgaccaggaaacuacaaacucggucacagacauggcucgagagccgcgaguacaccaagcaccugaucagaguugaaaacuggauuuuuaggaaucccggguucgcccuugcugccgcggcaaucgccuggcuguugggaaguuccacgucucagaaagugauauaucucgucaugauccugcugauugcuccugccuacagcauccgguguauuggcguguccaaccgcgacuuuguagagggcaugucagggggaacuuggguugauaucgugcucgaacaugguggcugcgucaccgugauggcacaggacaagccaacaguggauauagaguuagucacuaccacaguuaguaauauggcugaggugcgaagcuacuguuaugaagccucuauuuccgacauggcgucagauagcagaugccccacccaaggggaggccuaccuggacaagcagagugacacgcaguauguauguaaaaggacucuuguggaucggggauggggcaacgguugcggguuguucggaaagggcucucuggucacaugcgcaaaauuugcuuguuccaagaaaaugaccggcaagagcauccagccugaaaaucuagaguaccguauuaugcucucggugcacgggucucaacacuccggaaugaucguuaacgacacuggucaugaaacagaugagaaucgcgccaagguggagaucaccccaaacucacccagagcugaagccacgcugggcggguucggaagucuuggccuggacugcgagccuaggaccgguuuggauuuuagcgaccucuauuaccugacaaugaauaacaaacacugguuaguccauaaggaaugguuccacgauauuccacugccguggcacgcaggggccgacacuggcacaccccauuggaauaacaaagaggcucucguggaauuuaaggaugcgcacgcaaaacggcagaccguaguugugcuuggaucccaggagggcgccguccauacugcucuggccggggcauuggaggccgaaauggacggagcuaagggucgacuaucuagcggccaccugaaaugucgccucaagauggauaagcugagacuuaaaggggugucauauagucugugcaccgccgcauucacauuuaccaagauaccugcggagacuuugcauggaacggucacaguggaaguucaguacgcuggcaccgacgguccauguaaagugcccgcccaaauggcaguagacaugcagacucucaccccugucgggaggcugaucacagccaacccagugauuaccgaguccacugaaaauagcaagaugauguuagagcuggaucccccguucggcgacucuuacaucguuauaggagugggcgagaaaaagauuacacaccacuggcaucggucagggaguacgcuaggaaaggcuuuuagcaccacucucaaaggugcccagcgccuggcagcucuuggcgauacagccugggacuucggguccaucggaggcgucuucaacucuaucgguagagcggugcaccaaguauuugggggcgccuucaggaccuuguuuggaggcaugucguggauuacacaggggcugaugggagcucuccugcuuuggaugggcgugaaugcacgugaucggagcaucgcccuggcuuucuuggccacuggugggguucucgucuuucuggcaaccaacgugcaugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11653 - RNA, 2299 nt, Artificial Sequence
  ZIKV (isolate Z1106033) prME-short variant mRNA Design 3 opt
gggagaaagcuuaccaugaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacacgugcgaugccaccaugaguuacgaguguccuauguuagacgaaggaguggagccagaugacguagauugcugguguaauacaacuagcaccuggguggucuauggcacaugccaucacaaaaagggugaagcucgccgaucccguagagcagugacccugccgucucauucgacuaggaaacuacaaacacggucacagaccuggcucgagagccgcgaguacacgaagcaccugaucagaguugaaaacuggauuuuuaggaaucccggguucgcccuugcugccgcggcaaucgccuggcuguugggaaguuccacuucucagaaagugauauaucucgucaugauccugcugauugcuccugccuacagcauccgguguauuggcguguccaaccgcgacuuuguagagggcaugucagggggaaccuggguugaugugguccucgaacaugguggcugcgugacagugauggcacaggacaagccaacugucgauaucgaguuaguuaccacaaccgugaguaauauggcugagguacgaagcuacuguuaugaagccucuauauccgacauggcgucagauagcagaugccccacgcaaggggaggccuaccuggacaagcagagugacacucaguauguguguaaaaggacacuugucgaucggggauggggcaacgguugcggguuguucggaaagggcucucuggugaccugcgcaaaauuugcuuguuccaagaaaaugacuggcaagagcauucagccugaaaaucuagaguaccguaucaugcucucgguucacgggucucaacacuccggaaugauugugaacgacacaggucaugaaaccgaugagaaucgcgccaaggucgagaucacgccaaacucacccagagcugaagccacccugggcggguucggaagucuuggccuggacugcgagccuaggacagguuuggauuuuagcgaccucuauuaccugacuaugaauaacaaacacugguuagugcauaaggaaugguuccacgauaucccacugccguggcacgcaggggccgacaccggcacaccccauuggaauaacaaagaggcucucguagaauuuaaggaugcgcacgcaaaacggcagacuguugugguccuuggaucccaggagggcgccgugcauaccgcucuggccggggcauuggaggccgaaauggacggagcuaagggucgacuaucuagcggccaccugaaaugucgccucaagauggauaagcugagacuuaaaggggucucauauagucugugcacagccgcauucaccuuuacuaagauuccugcggagacguugcauggaacagugaccguugaagugcaguacgcuggcacugacgguccauguaaaguacccgcccaaauggcagucgacaugcagacccucacaccuguggggaggcugauaaccgccaacccaguuaucacugaguccacagaaaauagcaagaugauguuagagcuggaucccccguucggcgacucuuacauugugaucggagucggcgagaaaaagauaacgcaccacuggcaucggucagggaguacccuaggaaaggcuuuuagcacuacacucaaaggugcccagcgccuggcagcucuuggcgauaccgccugggacuucggguccauuggaggcguguucaacucuaucgguagagcgguacaccaaguguuugggggcgccuucaggacauuguuuggaggcaugucguggaucacucaggggcugaugggagcucuccugcuuuggaugggcguuaaugcacgugaucggagcauugcccuggcuuucuuggccaccggugggguccucguguuucuggcaacgaacgugcaugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11654 - RNA, 2287 nt, Artificial Sequence
  ZIKV (strain MR 766) prME-short variant mRNA Design 3 opt
gggagaaagcuuaccaugaacgagggcagcaucauguggcuggccucccucgcuguggucauugcaugcgccggggcgauaaccagaaggggaucugcuuacuauauguaccuugaccggucagaugccgguaaggcaaucaguuucgccacaacucugggcguuaauaaaugucacgugcagauuauggacuuggggcauaugugcgaugcuacgaugagcuaugaaugucccauguuagacgagggaguagaaccugaugacguggauugcugguguaacaccacauccacuugggucguguacgguaccugccaccauaagaaaggcgaggcacgccgaucucguagagccguuacacugccaucgcacucaaccaggaagcuacaaacucggagccagacauggcucgaaagucgcgaguauaccaaacaucugaucaagguggagaauuggauuuuuagaaacccgggguucgcucuugucgccguggcgaucgcauggcuguugggauccucuacgagccagaagguaauauaccucguuaugauccugcugauugcccccgcuuauuccaucagguguauuggcgugucaaaucgggacuuugucgaaggcaugagugggggaacuuggguggaugugguccucgagcacgguggcugcguuaccgugauggcccaggacaaaccuacaguagauaucgaauuagugacuaccacagucagcaacauggcagaggugcgcucuuacuguuacgaggcuuccauaucagacauggccagcgauagucgaugcccaacccaaggggaagcguaucuggacaagcagucugacacgcaguacguuuguaaaagaacucuuguggauaggggauggggcaaugguugcggguuguucggaaagggcucccuggucacaugcgccaaauuuaccuguagcaagaagaugacuggcaaaucgauucagcccgagaaccuagaauaucggaucaugcucucugugcacgggucccaacauucaggaaugauugguuacgagacagacgaagaucgugcaaagguagagguuaccccuaauaguccacgcgcugaggccacgcugggcggguucggaagccuuggccuggacugcgaacccagaaccgguuuggauuuuuccgaccucuauuaccugacaaugaacaauaaacacugguuagugcauaaggagugguuccacgauaucccucugccauggcacgcuggggccgacacuggcaccccgcauuggaacaauaaagaagcacucgucgaguuuaaggaugcccacgcuaaaaggcagacaguggucgugcuuggaucucaggaaggcgcgguucauacugcacuggccggggcuuuggaggccgagauggacggagcaaagggucggcuauucagcggccaccugaagugucgacucaaaauggauaagcugcgccuuaaaggggugucauauagucugugcaccgccgcuuuuacauucaccaagguacccgccgaaacuuugcauggaacggucacaguggagguucaguacgcaggcaccgacgguccuuguaaaaucccagugcaaauggcggucgacaugcagacucucacccccguggggagacugauuacagcuaacccuguaauaaccgaauccacugagaauagcaagaugauguuagaacuggauccacccuuuggcgacucuuacaucgugauuggaguuggcgauaagaaaaucacacaccacuggcauaggucagggaguacgcuaggaaaggccuucagcaccacucucaaaggugcacagcggcuggccgcucuuggcgacacagccugggauuucggguccauaggaggcgucuuuaacucuauuggucgcgcagugcaccaaguguucgggggcgcuuuuagaaccuuguucggaggcaugucguggaucacacaggggcugaugggagcccuccugcuuuggaugggcgucaacgcgagggaccguagcaucgcccuggcauuuuuggcuacuggugggguucucguguuccuggccaccaaugugcaugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11655 - RNA, 2299 nt, Artificial Sequence
  ZIKV (strain NatalRGN) prME-short variant mRNA Design 3 opt
gggagaaagcuuaccaugaacgagggcagcaucauguggcuggccucccucgcuguggucauugcaugcgccggggcgguuaccagaaggggaucugcuuacuauauguaccuugaccggaaugaugccggugaagcaauaucauuccccacaacucugggcaugaacaaguguuauauccagauuauggacuuggggcacaugugcgaugccacgaugaguuacgaguguccuauguuagacgaaggaguggagccagaugacguagauugcugguguaauaccacaagcacuuggguggucuaugguaccugccaucacaaaaagggcgaagcucgccgaucccguagagcagugacacugccgucucauucgaccaggaaacuacaaacucggucacagacauggcucgagagccgcgaguacaccaagcaccugaucagaguugaaaacuggauuuuuaggaaucccggguucgcccuugcugccgcggcaaucgccuggcuguugggaaguuccacgucucagaaagugauauaucucgucaugauccugcugauugcuccugccuacagcauccgguguauuggcguguccaaccgcgacuuuguagagggcaugucagggggaacuuggguugaugugguccucgaacaugguggcugcgugaccgugauggcacaggacaagccaacagucgauaucgaguuaguuacuaccacagugaguaauauggcugagguacgaagcuacuguuaugaagccucuauauccgacauggcgucagauagcagaugccccacccaaggggaggccuaccuggacaagcagagugacacgcaguauguguguaaaaggacucuugucgaucggggauggggcaacgguugcggguuguucggaaagggcucucuggugacaugcgcaaaauuugcuuguuccaagaaaaugaccggcaagagcauucagccugaaaaucuagaguaccguaucaugcucucgguucacgggucucaacacuccggaaugauugugaacgacacuggucaugaaacagaugagaaucgcgccaaggucgagaucaccccaaacucacccagagcugaagccacgcugggcggguucggaagucuuggccuggacugcgagccuaggaccgguuuggauuuuagcgaccucuauuaccugacaaugaauaacaaacacugguuagugcauaaggaaugguuccacgauaucccacugccguggcacgcaggggccgacacuggcacaccccauuggaauaacaaagaggcucucguagaauuuaaggaugcgcacgcaaaacggcagaccguugugguccuuggaucccaggagggcgccgugcauacugcucuggccggggcauuggaggccgaaauggacggagcuaagggucgacuaucuagcggccaccugaaaugucgccucaagauggauaagcugagacuuaaaggggucucauauagucugugcaccgccgcauucacauuuaccaagauuccugcggagacuuugcauggaacggugacaguugaagugcaguacgcuggcaccgacgguccauguaaaguacccgcccaaauggcagucgacaugcagacucucaccccuguggggaggcugauaacagccaacccaguuaucaccgaguccacugaaaauagcaagaugauguuagagcuggaucccccguucggcgacucuuacauugugaucggagucggcgagaaaaagauaacacaccacuggcaucggucagggaguacgcuaggaaaggcuuuuagcaccacucucaaaggugcccagcgccuggcagcucuuggcgauacagccugggacuucggguccauuggaggcguguucaacucuaucgguagagcgguacaccaaguguuugggggcgccuucaggaccuuguuuggaggcaugucguggaucacacaggggcugaugggagcucuccugcuuuggaugggcguuaaugcacgugaucggagcauugcccuggcuuucuuggccacuggugggguccucguguuucuggcaaccaacgugcaugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11656 - RNA, 2326 nt, Artificial Sequence; identical to SEQ ID NO: 11640
  ZIKV (strain ZikaSPH2015) ME variant mRNA Design 3 opt

SEQ ID NO: 11657 - RNA, 2326 nt, Artificial Sequence; identical to SEQ ID NO: 11641
  ZIKV (isolate Z1106033) ME variant mRNA Design 3 opt

SEQ ID NO: 11658 - RNA, 2314 nt, Artificial Sequence; identical to SEQ ID NO: 11642
  ZIKV (strain MR 766) ME variant mRNA Design 3 opt

SEQ ID NO: 11659 - RNA, 2326 nt, Artificial Sequence; identical to SEQ ID NO: 11643
  ZIKV (strain NatalRGN) ME variant mRNA Design 3 opt

SEQ ID NO: 11660 - RNA, 2299 nt, Artificial Sequence; identical to SEQ ID NO: 11644
  ZIKV (strain ZikaSPH2015) ME variant mRNA Design 3 opt

SEQ ID NO: 11661 - RNA, 2299 nt, Artificial Sequence; identical to SEQ ID NO: 11645
  ZIKV (isolate Z1106033) ME variant mRNA Design 3 opt

SEQ ID NO: 11662 - RNA, 2287 nt, Artificial Sequence; identical to SEQ ID NO: 11646
  ZIKV (strain MR 766) ME variant mRNA Design 3 opt

SEQ ID NO: 11663 - RNA, 2299 nt, Artificial Sequence; identical to SEQ ID NO: 11647
  ZIKV (strain NatalRGN) ME variant mRNA Design 3 opt

SEQ ID NO: 11664 - RNA, 2326 nt, Artificial Sequence
  ZIKV (strain ZikaSPH2015) prME-short variant mRNA Design 3 opt
gggagaaagcuuaccaugggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11665 - RNA, 2326 nt, Artificial Sequence
  ZIKV (isolate Z1106033) prME-short variant mRNA Design 3 opt
gggagaaagcuuaccaugggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11666 - RNA, 2314 nt, Artificial Sequence
  ZIKV (strain MR 766) prME-short variant mRNA Design 3 opt
gggagaaagcuuaccaugggcagaaagcagaacaagagaggcggcaacgagggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11667 - RNA, 2326 nt, Artificial Sequence
  ZIKV (strain NatalRGN) prME-short variant mRNA Design 3 opt
gggagaaagcuuaccaugggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11668 - RNA, 2299 nt, Artificial Sequence
  ZIKV (strain ZikaSPH2015) prME-short variant mRNA Design 3 opt
gggagaaagcuuaccaugaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11669 - RNA, 2299 nt, Artificial Sequence
  ZIKV (isolate Z1106033) prME-short variant mRNA Design 3 opt
gggagaaagcuuaccaugaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11670 - RNA, 2287 nt, Artificial Sequence
  ZIKV (strain MR 766) prME-short variant mRNA Design 3 opt
gggagaaagcuuaccaugaacgagggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11671 - RNA, 2299 nt, Artificial Sequence
  ZIKV (strain NatalRGN) prME-short variant mRNA Design 3 opt
gggagaaagcuuaccaugaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11672 - RNA, 2326 nt, Artificial Sequence
  ZIKV (strain ZikaSPH2015) prME-short variant mRNA Design 3 opt
gggagaaagcuuaccaugggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11673 - RNA, 2326 nt, Artificial Sequence
  ZIKV (isolate Z1106033) prME-short variant mRNA Design 3 opt
gggagaaagcuuaccaugggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11674 - RNA, 2314 nt, Artificial Sequence
  ZIKV (strain MR 766) prME-short variant mRNA Design 3 opt
gggagaaagcuuaccaugggcagaaagcagaacaagagaggcggcaacgagggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11675 - RNA, 2326 nt, Artificial Sequence
  ZIKV (strain NatalRGN) prME-short variant mRNA Design 3 opt
gggagaaagcuuaccaugggcagaaagcagaacaagagaggcggcaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11676 - RNA, 2299 nt, Artificial Sequence
  ZIKV (strain ZikaSPH2015) prME-short variant mRNA Design 3 opt
gggagaaagcuuaccaugaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11677 - RNA, 2299 nt, Artificial Sequence
  ZIKV (isolate Z1106033) prME-short variant mRNA Design 3 opt
gggagaaagcuuaccaugaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11678 - RNA, 2287 nt, Artificial Sequence
  ZIKV (strain MR 766) prME-short variant mRNA Design 3 opt
gggagaaagcuuaccaugaacgagggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11679 - RNA, 2299 nt, Artificial Sequence
  ZIKV (strain NatalRGN) prME-short variant mRNA Design 3 opt
gggagaaagcuuaccaugaacgagggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11680 - RNA, 2326 nt, Artificial Sequence; identical to SEQ ID NO: 11664
  ZIKV (strain ZikaSPH2015) ME variant mRNA Design 3 opt

SEQ ID NO: 11681 - RNA, 2326 nt, Artificial Sequence; identical to SEQ ID NO: 11665
  ZIKV (isolate Z1106033) ME variant mRNA Design 3 opt

SEQ ID NO: 11682 - RNA, 2314 nt, Artificial Sequence; identical to SEQ ID NO: 11666
  ZIKV (strain MR 766) ME variant mRNA Design 3 opt

SEQ ID NO: 11683 - RNA, 2326 nt, Artificial Sequence; identical to SEQ ID NO: 11667
  ZIKV (strain NatalRGN) ME variant mRNA Design 3 opt

SEQ ID NO: 11684 - RNA, 2299 nt, Artificial Sequence; identical to SEQ ID NO: 11668
  ZIKV (strain ZikaSPH2015) ME variant mRNA Design 3 opt

SEQ ID NO: 11685 - RNA, 2299 nt, Artificial Sequence; identical to SEQ ID NO: 11669
  ZIKV (isolate Z1106033) ME variant mRNA Design 3 opt

SEQ ID NO: 11686 - RNA, 2287 nt, Artificial Sequence; identical to SEQ ID NO: 11670
  ZIKV (strain MR 766) ME variant mRNA Design 3 opt

SEQ ID NO: 11687 - RNA, 2299 nt, Artificial Sequence; identical to SEQ ID NO: 11671
  ZIKV (strain NatalRGN) ME variant mRNA Design 3 opt

SEQ ID NO: 11688 - RNA, 2326 nt, Artificial Sequence
  ZIKV (strain ZikaSPH2015) prME-short variant mRNA Design 3 opt
gggagaaagcuuaccaugggcagaaagcagaacaaacggggcggaaaugagggcagcaucauguggcuggccucccucgcuguggucauugccugcgcgggggcuguuacccgcagaggaucugccuacuauauguaccuggaccggaacgaugccggcgaagcuaucagcuuccccacaacgcuugggaugaauaaguguuauauucaaaucauggaccugggacacaugugcgaugccaccauguccuacgaguguccuaugcucgacgaaggcguggagccggaugacguggauugcugguguaacacaaccucuacaugggucguguaugggaccugccaucacaaaaagggggaagcucgcagaagccggcgcgccguuacacugcccucccauucuaccagaaaacuucagacgcggagccagaccuggcuggagucccgcgaguacacaaagcaccucauuagaguggaaaauuggaucuuucggaacccuggauucgcgcuggccgcugccgcuaucgccuggcugcucggcagcucuaccucccagaaggucauuuaucuggugaugauccuucugauugcgcccgccuacagcauccgcuguauugggguuucuaauagagacuuuguggagggaauguccggcgggacaugggucgauaucgugcucgaacauggaggcugcgugaccgucauggcucaagacaaaccuacgguugauauugagcuggugacaaccacagugagcaacauggccgagguccggucuuacuguuaugaggcuuccaucagcgacauggccuccgauucucgcugccccacccagggcgaagccuaccuugacaagcagagcgacacccaguauguguguaaaagaacacugguugaucggggguggggaaauggcugcgggcuguucggaaagggcucccuggugacgugcgcuaaauuugcguguagcaagaagaugaccgggaaaucuauccaaccugaaaaccuggaguacagaauuaugcucuccguccacggaagccagcacucuggcaugaucgugaaugacacaggccaugaaaccgaugagaaccgcgccaagguugagauuacaccgaauagcccccgggcugaagccacccucgggggauucggcucccuugggcuggacugcgagccuagaacgggacucgauuuuucugaccuguauuaccuuacaaugaacaauaaacacuggcuggugcauaaggaaugguuccacgauaucccccucccuuggcacgccggcgcugacaccgggacaccccauuggaacaacaaagaggcccuggucgaauuuaaggaugcgcacgcuaaacgccagaccguggucgugcugggcagccaggagggagccguucauaccgcccucgcuggcgcccuggaggcugaaauggacggggccaagggacggcuuuccagcggccaccugaaguguagacucaaaauggauaagcugcgccuuaaaggggugucuuauucccugugcacagcggccuucacguuuaccaagauuccggcugagacacuccauggaaccgucacaguggaaguucaauacgccggcaccgacgggccuuguaaagugcccgcucagauggccgucgacaugcagacgcugaccccugugggccggcugaucacagcgaaucccgugaucaccgagagcacagaaaacucuaagaugaugcucgagcuggaucccccuuucggagacuccuacauuguuaucggcgucggggagaagaaaauuacccaccacuggcauagaagcggauccacgaucggcaaggccuuugaagcuacagugcgcggggccaaacggauggcugugcuuggagauaccgccugggacuucggcucugucgggggcgcccugaauagccucggaaagggcauucaccaaaucuucggggcugcguuuaaaucccuguucggaggcaugucuugguuuagccagauccugauugggacacuucucauguggcugggacugaacaccaagaauggcuccaucagccucaugugccuggcccuugggggcgugcugauuuuccucucuaccgcuguuuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11689 - RNA, 2326 nt, Artificial Sequence
  ZIKV (isolate Z1106033) prME-short variant mRNA Design 3 opt
gggagaaagcuuaccaugggcagaaagcagaacaaacgcgggggaaaugagggcagcaucauguggcuggccucccucgcuguggucauugccugcgcgggggcuguuacccggagaggaucugccuacuauauguaccuggaccggaacgaugccggcgaagcuaucagcuuccccacaacgcuugggaugaauaaguguuauauucaaaucauggaccugggacauaccugcgaugccacaauguccuacgaguguccuaugcucgacgaaggcguggagccggaugacguggauugcugguguaacaccacaucuaccugggucguguauggcacaugccaccacaaaaagggggaagcucgcagaagccggcgcgccguuacccugcccucccauucuacgagaaaacuucagacccggagccagacauggcuggagucccgcgaguacaccaagcaccucauuagaguggaaaauuggaucuuucggaacccuggauucgcgcuggccgcugccgcuaucgccuggcugcucggcagcucuacaucccagaaggucauuuaucuggugaugauccuucugauugcgcccgccuacagcauccgcuguauugggguuucuaauagagacuuuguggagggaauguccggcgggaccugggucgauguggugcucgaacauggaggcugcgucacgguuauggcucaagacaaaccuacaguggauaucgagcuggugaccacaaccgucagcaacauggccgaggugcggucuuacuguuaugaggcuuccauuagcgacauggccuccgauucucgcugccccacccagggcgaagccuaccuugacaagcagagcgacacacaguauguuuguaaaagaacgcugguggaucggggguggggaaauggcugcgggcuguucggaaagggcucccuggugaccugcgcuaaauuugcguguagcaagaagaugacagggaaaucuauccaaccugaaaaccuggaguacagaaucaugcucuccgugcacggaagccagcacucuggcaugauuguuaaugacaccggccaugaaacagaugagaaccgcgccaagguggagaucaccccgaauagcccccgggcugaagccacgcucgggggauucggcucccuugggcuggacugcgagccuagaacaggacucgauuuuucugaccuguauuaccuuaccaugaacaauaaacacuggcugguccauaaggaaugguuccacgauauuccccucccuuggcacgccggcgcugacaccgggacaccccauuggaacaacaaagaggcccugguggaauuuaaggaugcgcacgcuaaacgccagaccgucgugguucugggcagccaggagggagccgugcauacagcccucgcuggcgcccuggaggcugaaauggacggggccaagggacggcuuuccagcggccaccugaaguguagacucaaaauggauaagcugcgccuuaaaggggucucuuauucccugugcacggcggccuucaccuuuacaaagaucccggcugagacccuccauggaacagugaccguugaagugcaauacgccggcacggacgggccuuguaaaguccccgcucagauggccguggacaugcagacccugacaccugugggccggcugauuaccgcgaaucccguuaucacagagagcaccgaaaacucuaagaugaugcucgagcuggaucccccuuucggagacuccuacaucgucauuggcgugggggagaagaaaaucacgcaccacuggcauagaagcggauccacaauuggcaaggccuuugaagcuaccgugcgcggggccaaacggauggcuguccuuggagauacagccugggacuucggcucugucgggggcgcccugaauagccucggaaagggcauccaccaaauuuucggggcugcguuuaaaucccuguucggaggcaugucuugguuuagccagauccugaucgggacccuucucauguggcugggacugaacgccaagaauggcuccauuagccucaugugccuggcucuugggggcguucugaucuuccucucuaccgccguguccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11690 - RNA, 2314 nt, Artificial Sequence
  ZIKV (strain MR 766) prME-short variant mRNA Design 3 opt
gggagaaagcuuaccaugggcagaaagcagaacaaacggggcggaaaugagggcagcaucauguggcuggccucccucgcuguggucauugccugcgcgggggcuaucacccgcagaggaucugccuacuauauguaccuggaccggagcgaugccggcaaggcuauuuccuucgccacaacgcuugggguuaacaaaugucacgugcaaaucauggaccugggacauaugugcgaugcuaccaugucuuaugaaugucccaugcucgacgagggcguggaacccgaugacgucgauugcugguguaauacaaccagcacaugggugguuuacgggaccugccaccauaagaaaggggaggcccgcagaucccggcgcgcggugacacugccgucucacagcaccagaaagcugcagacgcggucccagaccuggcuggaaagccgcgaguauacaaagcaucucauuaaagucgagaacuggaucuuuagaaaucccggauucgcccugguggcuguugccaucgcuuggcugcucgggucuuccaccagccagaaggugauuuaccuggucaugauccuucugauugccccugcguauucuauccgguguauugggguguccaaccgcgacuuuguggaaggaaugagcggcgggacaugggucgauguugugcucgagcacggaggcugcgugaccgucauggcccaagacaaacccacgguggauaucgaacugguuacaaccacagugucuaauauggcugaggucagauccuacuguuacgaggccagcauuuccgacauggcuucugauagccggugcccuacccagggcgaagccuaucuugacaagcaguccgacacccaguacguguguaaacgcacacugguugauagaggguggggaaacggcugcggccucuucggaaagggcagccuggugacgugcgccaaguuuaccuguucuaaaaagaugacagggaaauccauccaacccgagaaucuggaauaucggaucaugcucagcguccacggaucucagcauagcggcaugauuggcuacgagaccgacgaagauagagcuaagguggaggucacaccuaacuccccgcgcgcggaggccacccuugggggauucggcucucuugggcuggacugcgaaccccggacgggacucgauuuuagcgaccuguauuaccuuacaaugaauaacaaacacuggcuggugcauaaggagugguuccacgauaucccucuccccuggcacgcuggcgccgacaccgggaccccucauuggaauaacaaagaagcccugguugaguuuaaggaugcucacgccaagagacagacaguggucgugcugggcucccaggaaggagcgguucauaccgcucucgccggcgcccuggaggcugagauggacggggccaaaggacgccuuuucagcggccaccugaagugucggcucaaaauggauaagcugagacuuaaaggggugucuuauucccugugcacagcugccuuuacguucaccaagguccccgcggaaacacuccauggaaccgugacaguggagguucaauacgccggcaccgacgggccguguaagauuccuguccagauggcuguggacaugcagacgcugacccccgugggccgccugaucacagccaauccugucauuaccgaaagcacagagaacucuaaaaugaugcucgaacuggauccucccuuuggagacuccuacaucgugaucggcguuggggauaagaaaauuacccaccacuggcaucggagcggauccacgaucggcaaggcuuucgaggccacagugagaggggcgaaacgcauggccguccuuggagacaccgcuugggauuucggcucuguugggggcguguuuaacagccugggaaagggcauucaccaaaucuucggggccgcuuuuaagucccucuucggaggcaugucuugguuuagccagauucugaucgggacacugcuuguguggcucggacugaauaccaaaaacggcuccaucagccugaccugccucgcccuugggggcgucaugauuuuccugucuacagccguguccgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11691 - RNA, 2326 nt, Artificial Sequence
  ZIKV (strain NatalRGN) prME-short variant mRNA Design 3 opt
gggagaaagcuuaccaugggcagaaagcagaacaaacggggcggaaaugagggcagcaucauguggcuggccucccucgcuguggucauugccugcgcgggggcuguuacccgcagaggaucugccuacuauauguaccuggaccggaacgaugccggcgaagcuaucagcuuccccacaacgcuugggaugaauaaguguuauauucaaaucauggaccugggacacaugugcgaugccaccauguccuacgaguguccuaugcucgacgaaggcguggagccggaugacguggauugcugguguaacacaaccucuacaugggucguguaugggaccugccaucacaaaaagggggaagcucgcagaagccggcgcgccguuacacugcccucccauucuaccagaaaacuucagacgcggagccagaccuggcuggagucccgcgaguacacaaagcaccucauuagaguggaaaauuggaucuuucggaacccuggauucgcgcuggccgcugccgcuaucgccuggcugcucggcagcucuaccucccagaaggucauuuaucuggugaugauccuucugauugcgcccgccuacagcauccgcuguauugggguuucuaauagagacuuuguggagggaauguccggcgggacaugggucgauguggugcucgaacauggaggcugcgucaccguuauggcucaagacaaaccuacgguggauaucgagcuggugacaaccacagucagcaacauggccgaggugcggucuuacuguuaugaggcuuccauuagcgacauggccuccgauucucgcugccccacccagggcgaagccuaccuugacaagcagagcgacacccaguauguuuguaaaagaacacugguggaucggggguggggaaauggcugcgggcuguucggaaagggcucccuggucacgugcgcuaaauuugcguguagcaagaagaugaccgggaaaucuauccaaccugaaaaccuggaguacagaaucaugcucuccgugcacggaagccagcacucuggcaugauuguuaaugacacaggccaugaaaccgaugagaaccgcgccaagguggagaucacaccgaauagcccccgggcugaagccacccucgggggauucggcucccuugggcuggacugcgagccuagaacgggacucgauuuuucugaccuguauuaccuuacaaugaacaauaaacacuggcugguccauaaggaaugguuccacgauauuccccucccuuggcacgccggcgcugacaccgggacaccccauuggaacaacaaagaggcccugguggaauuuaaggaugcgcacgcuaaacgccagaccgucgugguucugggcagccaggagggagccgugcauaccgcccucgcuggcgcccuggaggcugaaauggacggggccaagggacggcuuuccagcggccaccugaaguguagacucaaaauggauaagcugcgccuuaaaggggucucuuauucccugugcacagcggccuucacguuuaccaagaucccggcugagacacuccauggaaccgugacaguugaagugcaauacgccggcaccgacgggccuuguaaaguccccgcucagauggccguggacaugcagacgcugaccccugugggccggcugauuacagcgaaucccguuaucaccgagagcacagaaaacucuaagaugaugcucgagcuggaucccccuuucggagacuccuacaucgucauuggcgugggggagaagaaaaucacccaccacuggcauagaagcggauccacgauuggcaaggccuuugaagcuacagugcgcggggccaaacggauggcuguccuuggagauaccgccugggacuucggcucuguugggggcgcccugaauagccucggaaagggcauccaccaaauuuucggggcugcguuuaaaucccuguucggaggcaugucuugguuuagccagauccugaucgggacacuucucauguggcugggacugaacaccaagaauggcuccauuagccucaugugccuggcccuugggggcgugcugaucuuccucucuaccgcuguguccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11692 - RNA, 2299 nt, Artificial Sequence
  ZIKV (strain ZikaSPH2015) prME-short variant mRNA Design 3 opt
gggagaaagcuuaccaugaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacacaugugcgaugccaccauguccuacgaguguccuaugcucgacgaaggcguggagccggaugacguggauugcugguguaauacaaccucuacaugggucguguaugggaccugccaucacaaaaagggagaagcuagacggagccgcagagccguuacacugcccucccauucuacccggaaacuucaaacgcgcagccagaccuggcuggaguccagagaguacacaaagcaccucauucggguggaaaacuggaucuuucgcaauccuggcuucgcgcuggccgcugccgcuaucgccuggcugcucggcagcucuaccucccagaaagucauuuaucuggugaugauccuucugauugcgcccgccuacagcaucagauguauugggguuucuaaccgggacuuuguggagggaauguccggcgggacaugggucgauaucgugcucgaacauggaggcugcgugaccgucauggcucaggacaagccuacgguugauauugagcuggugacaaccacagugagcaauauggccgagguccgcucuuacuguuaugaggcuuccaucagcgacauggccuccgauucuagaugccccacccaaggggaagccuaccuugacaagcagagcgacacccaguauguguguaaacggacacugguugaucgcggauggggcaacggcugcggacucuucgggaagggcucccuggugacgugcgcuaaauuugcguguagcaagaaaaugaccgggaagucuauccagccugaaaaucuggaguacagaauuaugcucuccguccacggaagccaacacucuggcaugaucgugaacgacacagggcaugaaaccgaugagaaucgggccaagguugagauuacaccgaacagccccagagcugaagccacccugggaggcuucggcucccuugggcuggacugcgagccucgcacgggacucgauuuuucugaccuguauuaccuuacaaugaauaacaaacacuggcuggugcauaaggaaugguuccacgauaucccccucccuuggcacgccggcgcugacaccgggacaccccauuggaauaacaaagaggcccuggucgaauuuaaggaugcgcacgcuaaacggcagaccguggucgugcugggaagccaggagggcgccguucauaccgcccucgcuggggcccuggaggcugaaauggacggcgccaagggaagacuuuccagcggccaccugaaaugucgccucaagauggauaagcugcggcuuaaaggggugucuuauucccugugcacagcggccuucacguuuaccaagauuccggcugagacacuccauggaaccgucacaguggaaguucaguacgccggcaccgacgggccuuguaaagugcccgcucaaauggccgucgacaugcagacgcugaccccugugggaagacugaucacagcgaaccccgugaucaccgagagcacagaaaauucuaagaugaugcucgagcuggaucccccuuucggcgacuccuacauuguuaucggggucggcgagaaaaagauuacccaccacuggcaucgcagcggauccacgaucggcaaggccuuugaagcuacagugagaggggccaaacggauggcugugcuuggagauaccgccugggacuucggcucugucgggggagcccugaacagccucggcaaggggauucaccagaucuucggcgcugcguuuaaaucccuguucggaggcaugucuugguuuagccaaauccugauugggacacuucucauguggcugggacugaauaccaagaacggcuccaucagccucaugugccuggcccuugggggagugcugauuuuccucucuaccgcuguuuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11693 - RNA, 2299 nt, Artificial Sequence
  ZIKV (isolate Z1106033) prME-short variant mRNA Design 3 opt
gggagaaagcuuaccaugaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacauaccugcgaugccacaauguccuacgaguguccuaugcucgacgaaggcguggagccggaugacguggauugcugguguaauaccacaucuaccugggucguguaugggacaugccaccacaaaaagggagaagcuagacggagccgcagagccguuacccugcccucccauucuacgcggaaacuucaaacccgcagccagacauggcuggaguccagagaguacaccaagcaccucauucggguggaaaacuggaucuuucgcaauccuggcuucgcgcuggccgcugccgcuaucgccuggcugcucggcagcucuacaucccagaaagucauuuaucuggugaugauccuucugauugcgcccgccuacagcaucagauguauugggguuucuaaccgggacuuuguggagggaauguccggcgggaccugggucgauguggugcucgaacauggaggcugcgucacgguuauggcucaggacaagccuacaguggauaucgagcuggugaccacaaccgucagcaauauggccgaggugcgcucuuacuguuaugaggcuuccauuagcgacauggccuccgauucuagaugccccacccaaggggaagccuaccuugacaagcagagcgacacacaguauguuuguaaacggacgcugguggaucgcggauggggcaacggcugcggacucuucgggaagggcucccuggugaccugcgcuaaauuugcguguagcaagaaaaugacagggaagucuauccagccugaaaaucuggaguacagaaucaugcucuccgugcacggaagccaacacucuggcaugauuguuaacgacaccgggcaugaaacagaugagaaucgggccaagguggagaucaccccgaacagccccagagcugaagccacgcugggaggcuucggcucccuugggcuggacugcgagccucgcacaggacucgauuuuucugaccuguauuaccuuaccaugaauaacaaacacuggcugguccauaaggaaugguuccacgauauuccccucccuuggcacgccggcgcugacaccgggacaccccauuggaauaacaaagaggcccugguggaauuuaaggaugcgcacgcuaaacggcagaccgucgugguucugggaagccaggagggcgccgugcauacagcccucgcuggggcccuggaggcugaaauggacggcgccaagggaagacuuuccagcggccaccugaaaugucgccucaagauggauaagcugcggcuuaaaggggucucuuauucccugugcacggcggccuucaccuuuacaaagaucccggcugagacccuccauggaacagugaccguugaagugcaguacgccggcacggacgggccuuguaaaguccccgcucaaauggccguggacaugcagacccugacaccugugggaagacugauuaccgcgaaccccguuaucacagagagcaccgaaaauucuaagaugaugcucgagcuggaucccccuuucggcgacuccuacaucgucauuggggugggcgagaaaaagaucacgcaccacuggcaucgcagcggauccacaauuggcaaggccuuugaagcuaccgugagaggggccaaacggauggcuguccuuggagauacagccugggacuucggcucugucgggggagcccugaacagccucggcaaggggauccaccagauuuucggcgcugcguuuaaaucccuguucggaggcaugucuugguuuagccaaauccugaucgggacccuucucauguggcugggacugaaugccaagaacggcuccauuagccucaugugccuggcucuugggggaguucugaucuuccucucuaccgccguguccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11694 - RNA, 2287 nt, Artificial Sequence
  ZIKV (strain MR 766) prME-short variant mRNA Design 3 opt
gggagaaagcuuaccaugaacgagggcagcaucauguggcuggccucccucgcuguggucauugccugcgcgggggcuaucaccagacggggaucugccuacuauauguaccuggaccgcagcgaugccggcaaggcuauuuccuucgccacaacgcuugggguuaauaaaugucacgugcagaucauggaccugggacauaugugcgaugcuaccaugucuuaugaaugucccaugcucgacgagggcguggaacccgaugacgucgauugcugguguaacacaaccagcacaugggugguuuacgggaccugccaccauaagaaaggagaggccagacggucccgcagagcggugacacugccgucucacagcacccggaagcugcaaacgcgcucccagaccuggcuggaaagcagagaguauacaaaacaucucauuaaggucgagaauuggaucuuucggaaccccggcuucgcccugguggcuguugccaucgcuuggcugcucgggucuuccaccagccagaaggugauuuaccuggucaugauccuucugauugccccugcguauucuauccgcuguauugggguguccaauagagacuuuguggaaggaaugagcggcgggacaugggucgauguugugcucgagcacggaggcugcgugaccgucauggcccaggacaaacccacgguggauaucgaacugguuacaaccacagugucuaacauggcugagguccgguccuacuguuacgaggccagcauuuccgacauggcuucugauagccgcugcccuacccaaggggaagccuaucuugacaagcaguccgacacccaguacguguguaaaagaacacugguugaucggggauggggcaauggcugcggccucuucggaaagggcagccuggugacgugcgccaaauuuaccuguucuaagaagaugacagggaaauccauccagcccgagaaccuggaauaucgcaucaugcucagcguccacggaucucaacauagcggcaugauuggguacgagaccgacgaagauagagcuaagguggaggucacaccuaauuccccgcgggcggaggccacccugggaggcuucggcucucuugggcuggacugcgaacccagaacgggacucgauuuuagcgaccuguauuaccuuacaaugaacaauaaacacuggcuggugcauaaggagugguuccacgauaucccucuccccuggcacgcuggcgccgacaccgggaccccucauuggaacaauaaagaagcccugguugaguuuaaggaugcucacgccaaacgccagacaguggucgugcugggaucccaggaaggcgcgguucauaccgcucucgccggggcccuggaggcugagauggacggcgccaagggacggcuuuucagcggccaccugaaguguagacucaaaauggauaagcugcgccuuaaaggggugucuuauucccugugcacagcugccuuuacguucaccaagguccccgcggaaacacuccauggaaccgugacaguggagguucaguacgccggcaccgacgggccguguaaaauuccuguccaaauggcuguggacaugcagacgcugacccccgugggacggcugaucacagccaacccugucauuaccgaaagcacagaaaauucuaagaugaugcucgagcuggauccucccuuuggcgacuccuacaucgugaucgggguuggcgauaagaaaauuacccaccacuggcauagaagcggauccacgaucggcaaggcuuucgaggccacagugcgcggggcgaaacggauggccguccuuggagacaccgcuugggauuucggcucuguugggggaguguuuaacagccugggcaaggggauucaccagaucuucggcgccgcuuuuaaaucccucuucggaggcaugucuugguuuagccaaauucugaucgggacacugcuuguguggcucggacugaacaccaagaauggcuccaucagccugaccugccucgcccuugggggagucaugauuuuccuuucuacagccguguccgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11695 - RNA, 2299 nt, Artificial Sequence
  ZIKV (strain NatalRGN) prME-short variant mRNA Design 3 opt
gggagaaagcuuaccaugaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacacaugugcgaugccaccauguccuacgaguguccuaugcucgacgaaggcguggagccggaugacguggauugcugguguaauacaaccucuacaugggucguguaugggaccugccaucacaaaaagggagaagcuagacggagccgcagagccguuacacugcccucccauucuacccggaaacuucaaacgcgcagccagaccuggcuggaguccagagaguacacaaagcaccucauucggguggaaaacuggaucuuucgcaauccuggcuucgcgcuggccgcugccgcuaucgccuggcugcucggcagcucuaccucccagaaagucauuuaucuggugaugauccuucugauugcgcccgccuacagcaucagauguauugggguuucuaaccgggacuuuguggagggaauguccggcgggacaugggucgauguggugcucgaacauggaggcugcgucaccguuauggcucaggacaagccuacgguggauaucgagcuggugacaaccacagucagcaauauggccgaggugcgcucuuacuguuaugaggcuuccauuagcgacauggccuccgauucuagaugccccacccaaggggaagccuaccuugacaagcagagcgacacccaguauguuuguaaacggacacugguggaucgcggauggggcaacggcugcggacucuucgggaagggcucccuggucacgugcgcuaaauuugcguguagcaagaaaaugaccgggaagucuauccagccugaaaaucuggaguacagaaucaugcucuccgugcacggaagccaacacucuggcaugauuguuaacgacacagggcaugaaaccgaugagaaucgggccaagguggagaucacaccgaacagccccagagcugaagccacccugggaggcuucggcucccuugggcuggacugcgagccucgcacgggacucgauuuuucugaccuguauuaccuuacaaugaauaacaaacacuggcugguccauaaggaaugguuccacgauauuccccucccuuggcacgccggcgcugacaccgggacaccccauuggaauaacaaagaggcccugguggaauuuaaggaugcgcacgcuaaacggcagaccgucgugguucugggaagccaggagggcgccgugcauaccgcccucgcuggggcccuggaggcugaaauggacggcgccaagggaagacuuuccagcggccaccugaaaugucgccucaagauggauaagcugcggcuuaaaggggucucuuauucccugugcacagcggccuucacguuuaccaagaucccggcugagacacuccauggaaccgugacaguugaagugcaguacgccggcaccgacgggccuuguaaaguccccgcucaaauggccguggacaugcagacgcugaccccugugggaagacugauuacagcgaaccccguuaucaccgagagcacagaaaauucuaagaugaugcucgagcuggaucccccuuucggcgacuccuacaucgucauuggggugggcgagaaaaagaucacccaccacuggcaucgcagcggauccacgauuggcaaggccuuugaagcuacagugagaggggccaaacggauggcuguccuuggagauaccgccugggacuucggcucuguugggggagcccugaacagccucggcaaggggauccaccagauuuucggcgcugcguuuaaaucccuguucggaggcaugucuugguuuagccaaauccugaucgggacacuucucauguggcugggacugaauaccaagaacggcuccauuagccucaugugccuggcccuugggggagugcugaucuuccucucuaccgcuguguccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11696 - RNA, 2326 nt, Artificial Sequence
  ZIKV (strain ZikaSPH2015) prME-short variant mRNA Design 3 opt
gggagaaagcuuaccaugggcagaaagcagaacaaacggggcggaaaugagggcagcaucauguggcuggccucccucgcuguggucauugccugcgcgggggcuguuacccgcagaggaucugccuacuauauguaccuggaccggaacgaugccggcgaagcuaucagcuuccccacaacgcuugggaugaauaaguguuauauucaaaucauggaccugggacacaugugcgaugccaccauguccuacgaguguccuaugcucgacgaaggcguggagccggaugacguggauugcugguguaacacaaccucuacaugggucguguaugggaccugccaucacaaaaagggggaagcucgcagaagccggcgcgccguuacacugcccucccauucuaccagaaaacuucagacgcggagccagaccuggcuggagucccgcgaguacacaaagcaccucauuagaguggaaaauuggaucuuucggaacccuggauucgcgcuggccgcugccgcuaucgccuggcugcucggcagcucuaccucccagaaggucauuuaucuggugaugauccuucugauugcgcccgccuacagcauccgcuguauugggguuucuaauagagacuuuguggagggaauguccggcgggacaugggucgauaucgugcucgaacauggaggcugcgugaccgucauggcucaagacaaaccuacgguugauauugagcuggugacaaccacagugagcaacauggccgagguccggucuuacuguuaugaggcuuccaucagcgacauggccuccgauucucgcugccccacccagggcgaagccuaccuugacaagcagagcgacacccaguauguguguaaaagaacacugguugaucggggguggggaaauggcugcgggcuguucggaaagggcucccuggugacgugcgcuaaauuugcguguagcaagaagaugaccgggaaaucuauccaaccugaaaaccuggaguacagaauuaugcucuccguccacggaagccagcacucuggcaugaucgugaaugacacaggccaugaaaccgaugagaaccgcgccaagguugagauuacaccgaauagcccccgggcugaagccacccucgggggauucggcucccuugggcuggacugcgagccuagaacgggacucgauuuuucugaccuguauuaccuuacaaugaacaauaaacacuggcuggugcauaaggaaugguuccacgauaucccccucccuuggcacgccggcgcugacaccgggacaccccauuggaacaacaaagaggcccuggucgaauuuaaggaugcgcacgcuaaacgccagaccguggucgugcugggcagccaggagggagccguucauaccgcccucgcuggcgcccuggaggcugaaauggacggggccaagggacggcuuuccagcggccaccugaaguguagacucaaaauggauaagcugcgccuuaaaggggugucuuauucccugugcacagcggccuucacguuuaccaagauuccggcugagacacuccauggaaccgucacaguggaaguucaauacgccggcaccgacgggccuuguaaagugcccgcucagauggccgucgacaugcagacgcugaccccugugggccggcugaucacagcgaaucccgugaucaccgagagcacagaaaacucuaagaugaugcucgagcuggaucccccuuucggagacuccuacauuguuaucggcgucggggagaagaaaauuacccaccacuggcauagaagcggauccacgcuuggcaaggccuuuucuacaacccugaaaggggcucaacgccucgccgcucugggagauacagccugggacuucggcagcaucgggggcguguucaauuccauuggacgggccgugcaccaggucuuuggcggggcuuucagaacccuguuuggaggcaugucuuggaucacccaggggcuuaugggagcgcuccugcuguggaugggcgugaacgcccgcgaucggagcaucgcucucgccuuccuggccacagggggcguucuuguguuucuggcuacgaauguccaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11697 - RNA, 2326 nt, Artificial Sequence
  ZIKV (isolate Z1106033) prME-short variant mRNA Design 3 opt
gggagaaagcuuaccaugggcagaaagcagaacaaacgcgggggaaaugagggcagcaucauguggcuggccucccucgcuguggucauugccugcgcgggggcuguuacccggagaggaucugccuacuauauguaccuggaccggaacgaugccggcgaagcuaucagcuuccccacaacgcuugggaugaauaaguguuauauucaaaucauggaccugggacacacgugcgaugccacaauguccuacgaguguccuaugcucgacgaaggcguggagccggaugacguggauugcugguguaacaccacaucuaccugggucguguauggcacaugccaucacaaaaagggggaagcucgcagaagccggcgcgccguuacccugcccucccauucuacgagaaaacuucagacccggagccagacauggcuggagucccgcgaguacaccaagcaccucauuagaguggaaaauuggaucuuucggaacccuggauucgcgcuggccgcugccgcuaucgccuggcugcucggcagcucuacaucccagaaggucauuuaucuggugaugauccuucugauugcgcccgccuacagcauccgcuguauugggguuucuaauagagacuuuguggagggaauguccggcgggaccugggucgauguggugcucgaacauggaggcugcgucacgguuauggcucaagacaaaccuacaguggauaucgagcuggugaccacaaccgucagcaacauggccgaggugcggucuuacuguuaugaggcuuccauuagcgacauggccuccgauucucgcugccccacccagggcgaagccuaccuugacaagcagagcgacacacaguauguuuguaaaagaacgcugguggaucggggguggggaaauggcugcgggcuguucggaaagggcucccuggugaccugcgcuaaauuugcguguagcaagaagaugacagggaaaucuauccaaccugaaaaccuggaguacagaaucaugcucuccguccacggaagccagcacucuggcaugauuguuaaugacaccggccaugaaacagaugagaaccgcgccaagguggagaucaccccgaauagcccccgggcugaagccacgcucgggggauucggcucccuugggcuggacugcgagccuagaacaggacucgauuuuucugaccuguauuaccuuaccaugaacaauaaacacuggcugguccauaaggaaugguuccacgauauuccccucccuuggcacgccggcgcugacaccgggacaccccauuggaacaacaaagaggcccugguggaauuuaaggaugcgcacgcuaaacgccagaccgucgugguucugggcagccaggagggagccgugcauacagcccucgcuggcgcccuggaggcugaaauggacggggccaagggacggcuuuccagcggccaccugaaguguagacucaaaauggauaagcugcgccuuaaaggggucucuuauucccugugcacggcggccuucaccuuuacaaagaucccggcugagacccuccauggaacagugaccguugaagugcaauacgccggcacggacgggccuuguaaaguccccgcucagauggccguggacaugcagacccugacaccugugggccggcugauuaccgcgaaucccguuaucacagagagcaccgaaaacucuaagaugaugcucgagcuggaucccccuuucggagacuccuacaucgucauuggcgugggggagaagaaaaucacgcaccacuggcauagaagcggauccacacuuggcaaggccuuuucuaccacacugaaaggggcucaacgccucgccgcucugggagauaccgccugggacuucggcagcauugggggcguguucaauuccaucggacgggccguccaccagguguuuggcggggcuuucagaacccuguuuggaggcaugucuuggauuacacaggggcuuaugggagcgcuccugcuguggaugggcguuaacgcccgcgaucggagcaucgcucucgccuuccuggccaccgggggcgugcuugucuuucuggcuaccaaugugcaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11698 - RNA, 2314 nt, Artificial Sequence
  ZIKV (strain MR 766) prME-short variant mRNA Design 3 opt
gggagaaagcuuaccaugggcagaaagcagaacaaacggggcggaaaugagggcagcaucauguggcuggccucccucgcuguggucauugccugcgcgggggcuaucacccgcagaggaucugccuacuauauguaccuggaccggagcgaugccggcaaggcuauuuccuucgccacaacgcuugggguuaacaaaugucacgugcaaaucauggaccugggacauaugugcgaugcuaccaugucuuaugaaugucccaugcucgacgagggcguggaacccgaugacgucgauugcugguguaauacaaccagcacaugggugguuuacgggaccugccaccauaagaaaggggaggcccgcagaucccggcgcgcggugacacugccgucucacagcaccagaaagcugcagacgcggucccagaccuggcuggaaagccgcgaguauacaaagcaucucauuaaagucgagaacuggaucuuuagaaaucccggauucgcccugguggcuguugccaucgcuuggcugcucgggucuuccaccagccagaaggugauuuaccuggucaugauccuucugauugccccugcguauucuauccgguguauugggguguccaaccgcgacuuuguggaaggaaugagcggcgggacaugggucgauguugugcucgagcacggaggcugcgugaccgucauggcccaagacaaacccacgguggauaucgaacugguuacaaccacagugucuaauauggcugaggucagauccuacuguuacgaggccagcauuuccgacauggcuucugauagccggugcccuacccagggcgaagccuaucuugacaagcaguccgacacccaguacguguguaaacgcacacugguugauagaggguggggaaacggcugcggccucuucggaaagggcagccuggugacgugcgccaaguuuaccuguucuaaaaagaugacagggaaauccauccaacccgagaaucuggaauaucggaucaugcucagcguccacggaucucagcauagcggcaugauuggcuacgagaccgacgaagauagagcuaagguggaggucacaccuaacuccccgcgcgcggaggccacccuugggggauucggcucucuugggcuggacugcgaaccccggacgggacucgauuuuagcgaccuguauuaccuuacaaugaauaacaaacacuggcuggugcauaaggagugguuccacgauaucccucuccccuggcacgcuggcgccgacaccgggaccccucauuggaauaacaaagaagcccugguugaguuuaaggaugcucacgccaagagacagacaguggucgugcugggcucccaggaaggagcgguucauaccgcucucgccggcgcccuggaggcugagauggacggggccaaaggacgccuuuucagcggccaccugaagugucggcucaaaauggauaagcugagacuuaaaggggugucuuauucccugugcacagcugccuuuacguucaccaagguccccgcggaaacacuccauggaaccgugacaguggagguucaauacgccggcaccgacgggccguguaagauuccuguccagauggcuguggacaugcagacgcugacccccgugggccgccugaucacagccaauccugucauuaccgaaagcacagagaacucuaaaaugaugcucgaacuggauccucccuuuggagacuccuacaucgugaucggcguuggggauaagaaaauuacccaccacuggcaucggagcggauccacgcuuggcaaggcuuucucuacaacccugaaaggggcccaaagacucgcggcccugggagacacagcuugggauuucggcagcaucgggggcguguuuaacuccauuggacgcgccguccaccagguguucggcggggcuuuucggacccuguucggaggcaugucuuggaucacccaggggcuuaugggagcccuccugcuguggaugggcguuaaugccagagaccgcagcauugcucucgcguuucuggccacagggggcgugcuugucuuccuggcuacgaacgugcaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11699 - RNA, 2326 nt, Artificial Sequence
  ZIKV (strain NatalRGN) prME-short variant mRNA Design 3 opt
gggagaaagcuuaccaugggcagaaagcagaacaaacggggcggaaaugagggcagcaucauguggcuggccucccucgcuguggucauugccugcgcgggggcuguuacccgcagaggaucugccuacuauauguaccuggaccggaacgaugccggcgaagcuaucagcuuccccacaacgcuugggaugaauaaguguuauauucaaaucauggaccugggacacaugugcgaugccaccauguccuacgaguguccuaugcucgacgaaggcguggagccggaugacguggauugcugguguaacacaaccucuacaugggucguguaugggaccugccaucacaaaaagggggaagcucgcagaagccggcgcgccguuacacugcccucccauucuaccagaaaacuucagacgcggagccagaccuggcuggagucccgcgaguacacaaagcaccucauuagaguggaaaauuggaucuuucggaacccuggauucgcgcuggccgcugccgcuaucgccuggcugcucggcagcucuaccucccagaaggucauuuaucuggugaugauccuucugauugcgcccgccuacagcauccgcuguauugggguuucuaauagagacuuuguggagggaauguccggcgggacaugggucgauguggugcucgaacauggaggcugcgucaccguuauggcucaagacaaaccuacgguggauaucgagcuggugacaaccacagucagcaacauggccgaggugcggucuuacuguuaugaggcuuccauuagcgacauggccuccgauucucgcugccccacccagggcgaagccuaccuugacaagcagagcgacacccaguauguuuguaaaagaacacugguggaucggggguggggaaauggcugcgggcuguucggaaagggcucccuggucacgugcgcuaaauuugcguguagcaagaagaugaccgggaaaucuauccaaccugaaaaccuggaguacagaaucaugcucuccgugcacggaagccagcacucuggcaugauuguuaaugacacaggccaugaaaccgaugagaaccgcgccaagguggagaucacaccgaauagcccccgggcugaagccacccucgggggauucggcucccuugggcuggacugcgagccuagaacgggacucgauuuuucugaccuguauuaccuuacaaugaacaauaaacacuggcugguccauaaggaaugguuccacgauauuccccucccuuggcacgccggcgcugacaccgggacaccccauuggaacaacaaagaggcccugguggaauuuaaggaugcgcacgcuaaacgccagaccgucgugguucugggcagccaggagggagccgugcauaccgcccucgcuggcgcccuggaggcugaaauggacggggccaagggacggcuuuccagcggccaccugaaguguagacucaaaauggauaagcugcgccuuaaaggggucucuuauucccugugcacagcggccuucacguuuaccaagaucccggcugagacacuccauggaaccgugacaguugaagugcaauacgccggcaccgacgggccuuguaaaguccccgcucagauggccguggacaugcagacgcugaccccugugggccggcugauuacagcgaaucccguuaucaccgagagcacagaaaacucuaagaugaugcucgagcuggaucccccuuucggagacuccuacaucgucauuggcgugggggagaagaaaaucacccaccacuggcauagaagcggauccacgcuuggcaaggccuuuucuacaacccugaaaggggcucaacgccucgccgcucugggagauacagccugggacuucggcagcauugggggcguguucaauuccaucggacgggccguccaccagguguuuggcggggcuuucagaacccuguuuggaggcaugucuuggauuacccaggggcuuaugggagcgcuccugcuguggaugggcguuaacgcccgcgaucggagcaucgcucucgccuuccuggccacagggggcgugcuugucuuucuggcuacgaaugugcaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11700 - RNA, 2299 nt, Artificial Sequence
  ZIKV (strain ZikaSPH2015) prME-short variant mRNA Design 3 opt
gggagaaagcuuaccaugaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacacaugugcgaugccaccauguccuacgaguguccuaugcucgacgaaggcguggagccggaugacguggauugcugguguaauacaaccucuacaugggucguguaugggaccugccaucacaaaaagggagaagcuagacggagccgcagagccguuacacugcccucccauucuacccggaaacuucaaacgcgcagccagaccuggcuggaguccagagaguacacaaagcaccucauucggguggaaaacuggaucuuucgcaauccuggcuucgcgcuggccgcugccgcuaucgccuggcugcucggcagcucuaccucccagaaagucauuuaucuggugaugauccuucugauugcgcccgccuacagcaucagauguauugggguuucuaaccgggacuuuguggagggaauguccggcgggacaugggucgauaucgugcucgaacauggaggcugcgugaccgucauggcucaggacaagccuacgguugauauugagcuggugacaaccacagugagcaauauggccgagguccgcucuuacuguuaugaggcuuccaucagcgacauggccuccgauucuagaugccccacccaaggggaagccuaccuugacaagcagagcgacacccaguauguguguaaacggacacugguugaucgcggauggggcaacggcugcggacucuucgggaagggcucccuggugacgugcgcuaaauuugcguguagcaagaaaaugaccgggaagucuauccagccugaaaaucuggaguacagaauuaugcucuccguccacggaagccaacacucuggcaugaucgugaacgacacagggcaugaaaccgaugagaaucgggccaagguugagauuacaccgaacagccccagagcugaagccacccugggaggcuucggcucccuugggcuggacugcgagccucgcacgggacucgauuuuucugaccuguauuaccuuacaaugaauaacaaacacuggcuggugcauaaggaaugguuccacgauaucccccucccuuggcacgccggcgcugacaccgggacaccccauuggaauaacaaagaggcccuggucgaauuuaaggaugcgcacgcuaaacggcagaccguggucgugcugggaagccaggagggcgccguucauaccgcccucgcuggggcccuggaggcugaaauggacggcgccaagggaagacuuuccagcggccaccugaaaugucgccucaagauggauaagcugcggcuuaaaggggugucuuauucccugugcacagcggccuucacguuuaccaagauuccggcugagacacuccauggaaccgucacaguggaaguucaguacgccggcaccgacgggccuuguaaagugcccgcucaaauggccgucgacaugcagacgcugaccccugugggaagacugaucacagcgaaccccgugaucaccgagagcacagaaaauucuaagaugaugcucgagcuggaucccccuuucggcgacuccuacauuguuaucggggucggcgagaaaaagauuacccaccacuggcaucgcagcggauccacgcuuggcaaggccuuuucuacaacccugaaaggggcucagcggcucgccgcucugggagauacagccugggacuucggcagcaucgggggaguguucaacuccauuggcagagccgugcaccaagucuuugggggcgcuuuccgcacccuguuuggaggcaugucuuggaucacccaggggcuuaugggagcgcuccugcuguggaugggcgugaaugcccgggauagaagcaucgcucucgccuuccuggccacagggggaguucuuguguuucuggcuacgaacguccaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11701 - RNA, 2299 nt, Artificial Sequence
  ZIKV (isolate Z1106033) prME-short variant mRNA Design 3 opt
gggagaaagcuuaccaugaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacacacgugcgaugccacaauguccuacgaguguccuaugcucgacgaaggcguggagccggaugacguggauugcugguguaauaccacaucuaccugggucguguaugggacaugccaucacaaaaagggagaagcuagacggagccgcagagccguuacccugcccucccauucuacgcggaaacuucaaacccgcagccagacauggcuggaguccagagaguacaccaagcaccucauucggguggaaaacuggaucuuucgcaauccuggcuucgcgcuggccgcugccgcuaucgccuggcugcucggcagcucuacaucccagaaagucauuuaucuggugaugauccuucugauugcgcccgccuacagcaucagauguauugggguuucuaaccgggacuuuguggagggaauguccggcgggaccugggucgauguggugcucgaacauggaggcugcgucacgguuauggcucaggacaagccuacaguggauaucgagcuggugaccacaaccgucagcaauauggccgaggugcgcucuuacuguuaugaggcuuccauuagcgacauggccuccgauucuagaugccccacccaaggggaagccuaccuugacaagcagagcgacacacaguauguuuguaaacggacgcugguggaucgcggauggggcaacggcugcggacucuucgggaagggcucccuggugaccugcgcuaaauuugcguguagcaagaaaaugacagggaagucuauccagccugaaaaucuggaguacagaaucaugcucuccguccacggaagccaacacucuggcaugauuguuaacgacaccgggcaugaaacagaugagaaucgggccaagguggagaucaccccgaacagccccagagcugaagccacgcugggaggcuucggcucccuugggcuggacugcgagccucgcacaggacucgauuuuucugaccuguauuaccuuaccaugaauaacaaacacuggcugguccauaaggaaugguuccacgauauuccccucccuuggcacgccggcgcugacaccgggacaccccauuggaauaacaaagaggcccugguggaauuuaaggaugcgcacgcuaaacggcagaccgucgugguucugggaagccaggagggcgccgugcauacagcccucgcuggggcccuggaggcugaaauggacggcgccaagggaagacuuuccagcggccaccugaaaugucgccucaagauggauaagcugcggcuuaaaggggucucuuauucccugugcacggcggccuucaccuuuacaaagaucccggcugagacccuccauggaacagugaccguugaagugcaguacgccggcacggacgggccuuguaaaguccccgcucaaauggccguggacaugcagacccugacaccugugggaagacugauuaccgcgaaccccguuaucacagagagcaccgaaaauucuaagaugaugcucgagcuggaucccccuuucggcgacuccuacaucgucauuggggugggcgagaaaaagaucacgcaccacuggcaucgcagcggauccacacuuggcaaggccuuuucuaccacacugaaaggggcucagcggcucgccgcucugggagauaccgccugggacuucggcagcauugggggaguguucaacuccaucggcagagccguccaccaaguguuugggggcgcuuuccgcacccuguuuggaggcaugucuuggauuacacaggggcuuaugggagcgcuccugcuguggaugggcguuaaugcccgggauagaagcaucgcucucgccuuccuggccaccgggggagugcuugucuuucuggcuaccaacgugcaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11702 - RNA, 2287 nt, Artificial Sequence
  ZIKV (strain MR 766) prME-short variant mRNA Design 3 opt
gggagaaagcuuaccaugaacgagggcagcaucauguggcuggccucccucgcuguggucauugccugcgcgggggcuaucaccagacggggaucugccuacuauauguaccuggaccgcagcgaugccggcaaggcuauuuccuucgccacaacgcuugggguuaauaaaugucacgugcagaucauggaccugggacauaugugcgaugcuaccaugucuuaugaaugucccaugcucgacgagggcguggaacccgaugacgucgauugcugguguaacacaaccagcacaugggugguuuacgggaccugccaccauaagaaaggagaggccagacggucccgcagagcggugacacugccgucucacagcacccggaaacuucaaacgcgcucccagaccuggcuggaaagcagagaguauacaaagcaucucauuaaggucgagaauuggaucuuucggaaccccggcuucgcccugguggcuguugccaucgcuuggcugcucgggucuuccaccagccagaaggugauuuaccuggucaugauccuucugauugccccugcguauucuauccgcuguauugggguguccaauagagacuuuguggaaggaaugagcggcgggacaugggucgauguugugcucgagcacggaggcugcgugaccgucauggcccaggacaaacccacgguggauaucgaacugguuacaaccacagugucuaacauggcugagguccgguccuacuguuacgaggccagcauuuccgacauggcuucugauagccgcugcccuacccaaggggaagccuaucuugacaagcaguccgacacccaguacguguguaaaagaacacugguugaucggggauggggcaauggcugcggccucuucggaaagggcagccuggugacgugcgccaaauuuaccuguucuaagaagaugacagggaaauccauccagcccgagaaccuggaauaucgcaucaugcucagcguccacggaucucaacauagcggcaugauuggguacgagaccgacgaagauagagcuaagguggaggucacaccuaauuccccgcgggcggaggccacccugggaggcuucggcucucuugggcuggacugcgaacccagaacgggacucgauuuuagcgaccuguauuaccuuacaaugaacaauaaacacuggcuggugcauaaggagugguuccacgauaucccucuccccuggcacgcuggcgccgacaccgggaccccucauuggaacaauaaagaagcccugguugaguuuaaggaugcucacgccaaacgccagacaguggucgugcugggaucccaggaaggcgcgguucauaccgcucucgccggggcccuggaggcugagauggacggcgccaagggacggcuuuucagcggccaccugaaguguagacucaaaauggauaagcugcgccuuaaaggggugucuuauucccugugcacagcugccuuuacguucaccaagguccccgcggaaacacuccauggaaccgugacaguggagguucaguacgccggcaccgacgggccguguaaaauuccuguccaaauggcuguggacaugcagacgcugacccccgugggacggcugaucacagccaacccugucauuaccgaaagcacagaaaauucuaagaugaugcucgagcuggauccucccuuuggcgacuccuacaucgugaucgggguuggcgauaagaaaauuacccaccacuggcauagaagcggauccacgcuuggcaaggcuuucucuacaacccugaaaggggcccagcgccucgcggcccugggagacacagcuugggauuucggcagcaucgggggaguguuuaacuccauuggccgggccguccaccaaguguucgggggcgcuuuuagaacccuguucggaggcaugucuuggaucacccaggggcuuaugggagcccuccugcuguggaugggcguuaacgcccgcgaccggagcauugcucucgcguuucuggccacagggggagugcuugucuuccuggcuacgaaugugcaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11703 - RNA, 2299 nt, Artificial Sequence
  ZIKV (strain NatalRGN) prME-short variant mRNA Design 3 opt
gggagaaagcuuaccaugaacgagggcagcaucauguggcuggccucccucgcuguggucauugccugcgcgggggcuguuaccagacggggaucugccuacuauauguaccuggaccgcaaugaugccggcgaagcuaucagcuuccccacaacgcuugggaugaacaaguguuauauucagaucauggaccugggacacaugugcgaugccaccauguccuacgaguguccuaugcucgacgaaggcguggagccggaugacguggauugcugguguaauacaaccucuacaugggucguguaugggaccugccaucacaaaaagggagaagcuagacggagccgcagagccguuacacugcccucccauucuacccggaaacuucaaacgcgcagccagaccuggcuggaguccagagaguacacaaagcaccucauucggguggaaaacuggaucuuucgcaauccuggcuucgcgcuggccgcugccgcuaucgccuggcugcucggcagcucuaccucccagaaagucauuuaucuggugaugauccuucugauugcgcccgccuacagcaucagauguauugggguuucuaaccgggacuuuguggagggaauguccggcgggacaugggucgauguggugcucgaacauggaggcugcgucaccguuauggcucaggacaagccuacgguggauaucgagcuggugacaaccacagucagcaauauggccgaggugcgcucuuacuguuaugaggcuuccauuagcgacauggccuccgauucuagaugccccacccaaggggaagccuaccuugacaagcagagcgacacccaguauguuuguaaacggacacugguggaucgcggauggggcaacggcugcggacucuucgggaagggcucccuggucacgugcgcuaaauuugcguguagcaagaaaaugaccgggaagucuauccagccugaaaaucuggaguacagaaucaugcucuccgugcacggaagccaacacucuggcaugauuguuaacgacacagggcaugaaaccgaugagaaucgggccaagguggagaucacaccgaacagccccagagcugaagccacccugggaggcuucggcucccuugggcuggacugcgagccucgcacgggacucgauuuuucugaccuguauuaccuuacaaugaauaacaaacacuggcugguccauaaggaaugguuccacgauauuccccucccuuggcacgccggcgcugacaccgggacaccccauuggaauaacaaagaggcccugguggaauuuaaggaugcgcacgcuaaacggcagaccgucgugguucugggaagccaggagggcgccgugcauaccgcccucgcuggggcccuggaggcugaaauggacggcgccaagggaagacuuuccagcggccaccugaaaugucgccucaagauggauaagcugcggcuuaaaggggucucuuauucccugugcacagcggccuucacguuuaccaagaucccggcugagacacuccauggaaccgugacaguugaagugcaguacgccggcaccgacgggccuuguaaaguccccgcucaaauggccguggacaugcagacgcugaccccugugggaagacugauuacagcgaaccccguuaucaccgagagcacagaaaauucuaagaugaugcucgagcuggaucccccuuucggcgacuccuacaucgucauuggggugggcgagaaaaagaucacccaccacuggcaucgcagcggauccacgcuuggcaaggccuuuucuacaacccugaaaggggcucagcggcucgccgcucugggagauacagccugggacuucggcagcauugggggaguguucaacuccaucggcagagccguccaccaaguguuugggggcgcuuuccgcacccuguuuggaggcaugucuuggauuacccaggggcuuaugggagcgcuccugcuguggaugggcguuaaugcccgggauagaagcaucgcucucgccuuccuggccacagggggagugcuugucuuucuggcuacgaacgugcaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11704 - RNA, 2326 nt, Artificial Sequence; identical to SEQ ID NO: 11688
  ZIKV (strain ZikaSPH2015) ME variant mRNA Design 3 opt

SEQ ID NO: 11705 - RNA, 2326 nt, Artificial Sequence; identical to SEQ ID NO: 11689
  ZIKV (isolate Z1106033) ME variant mRNA Design 3 opt

SEQ ID NO: 11706 - RNA, 2314 nt, Artificial Sequence; identical to SEQ ID NO: 11690
  ZIKV (strain MR 766) ME variant mRNA Design 3 opt

SEQ ID NO: 11707 - RNA, 2326 nt, Artificial Sequence; identical to SEQ ID NO: 11691
  ZIKV (strain NatalRGN) ME variant mRNA Design 3 opt

SEQ ID NO: 11708 - RNA, 2299 nt, Artificial Sequence; identical to SEQ ID NO: 11692
  ZIKV (strain ZikaSPH2015) ME variant mRNA Design 3 opt

SEQ ID NO: 11709 - RNA, 2299 nt, Artificial Sequence; identical to SEQ ID NO: 11693
  ZIKV (isolate Z1106033) ME variant mRNA Design 3 opt

SEQ ID NO: 11710 - RNA, 2287 nt, Artificial Sequence; identical to SEQ ID NO: 11694
  ZIKV (strain MR 766) ME variant mRNA Design 3 opt

SEQ ID NO: 11711 - RNA, 2299 nt, Artificial Sequence; identical to SEQ ID NO: 11695
  ZIKV (strain NatalRGN) ME variant mRNA Design 3 opt

SEQ ID NO: 11712 - RNA, 2326 nt, Artificial Sequence
  ZIKV (strain ZikaSPH2015) prME-short variant mRNA Design 3 opt
gggagaaagcuuaccaugggaagaaaacaaaacaaaagaggcggcaaugaaggaagcauuaugugguuagcaucacuagcaguaguaauagcaugugcgggcgcaguuacacgcagagguagugcauacuacauguaucuagauagaaaugaugcaggagaagcaauaucauuucccaccacauuaggaaugaauaaauguuauauucaaauaauggaucuaggacauaugugcgaugcaaccaugucauacgaaugccccaugcuagaugaaggaguagaacccgacgacguagauugcuggugcaauacgacuucaacauggguaguauacgggacaugccaucauaagaaaggggaagcccgaagaaguaggagagcaguaacacuaccuucucauucaacuagaaaauuacaaacuagaagucaaacuuggcuugaaucaagagaauauacaaaacaucuaauuagaguugaaaacuggauauucagaaacccagguuucgcauuagcugcugccgcgauagcaugguuauuaggcucaaguacuucacaaaaaguaauuuauuugguuaugauauuauuaauugcuccagcuuacucuauaagauguauaggugucagcaaucgagauuucguugaaggaaugucuggggguacaugggucgacauaguccuagaacaugggggauguguaacagugauggcacaagauaaaccuacaguugacauagaauuagugacaacaacugucucaaauauggcggagguaagauccuacuguuaugaagcaucaaucucagauauggcaagugacagcagaugcccaacccaaggugaagcauaccuugacaaacaaagcgacacccaauauguauguaaacguacauuaguagauagaggguggggaaacggguguggauuauuuggaaagggaagucuaguaacaugugcaaaauucgcauguuccaagaaaaugacaggaaaaucaauacaaccagaaaauuuggaauauagaauaauguuaucaguucacggaucacaacacucgggaaugauuguaaacgauacuggacaugaaacagacgaaaauagagcaaaaguagaaauaacuccaaacucaccgagagcagaagcaacacucggugguuucggaucauuaggauuggauugugaaccaaggaccggacuggacuucucagauuuauacuacuuaacaaugaauaauaaacauuggcugguacauaaagaaugguuccacgacauaccauuaccauggcaugcaggagcagauacaggaacaccacacuggaauaauaaagaagcucuaguugaguuuaaagaugcucaugcaaaaagacaaacagucguuguauuagggagucaagaaggagcgguucauacagcauuagcaggagcauuggaagccgaaauggacggagcaaaaggaagauuaaguucaggccacuuaaaauguagauugaaaauggacaaauuaagacuaaaaggaguaucguauagccuaugcacagcagcauuuacauuuacaaaaauaccagcagaaacccuacaugguacaguaacaguagaaguucaauacgcaggaacagaugguccuuguaaaguuccagcccagauggcaguagauaugcagacauuaacaccagucggcagauuaauaacagccaauccgguaauaacagaaucaacagaaaauagcaaaaugauguuagaacuagacccacccuuuggcgauucauauauaguaauagguguaggagaaaagaaaauaacucaucacuggcaucgaaguggaucaacuauagguaaagcauuugaagcaacaguacgcggagcaaaaagaauggcuguauuaggagauacggccugggacuuugguucaguugguggagcacuaaacucacuaggcaaaggaauacaucaaauuuuuggcgcagcuuucaaaucauuauuuggaggaaugucuugguucucacaaauauuaauaggaacauuauuaaugugguuaggauuaaacacuaaaaauggaucaauaaguuugaugugccuagcuuuaggugguguacuaauauuucuaucaacagcaguuucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11713 - RNA, 2326 nt, Artificial Sequence
  ZIKV (isolate Z1106033) prME-short variant mRNA Design 3 opt
gggagaaagcuuaccaugggacguaaacaaaauaaaagagguggaaaugaaggaaguauuaugugguuggcaagcuuagcaguaguaauagcaugcgcgggggcuguaacuaggaggggaagugcauacuacauguaucuagacagaaacgaugcaggugaagcaauuaguuuuccuacuacauuaggcaugaauaaauguuacauacaaaucauggauuuaggacauacaugugaugcaacuaugaguuaugaauguccuauguuagaugaaggcguugaaccagaugacguagacuguugguguaauacaacaaguacuuggguaguauaugggacgugucaucacaaaaaaggagaagcaagaagaucaagaagagcuguuacacuuccaagucauucgacaagaaaacuacagacaagaucucagacuuggcuagaaagcagagaauauaccaaacauuuaauuagaguagagaauuggauauuuagaaauccaggauucgcauuagcagcagcugcaauagcaugguuauuaggaagcaguacgucacaaaagguaauauaccuaguaaugauauuauuaauagcaccugcauacaguauaagaugcauaggaguaaguaacagagauuuuguagaaggcaugagugguggaacauggguagaugucguacuugagcaugguggguguguaacuguaauggcacaagauaaaccaacaguagacaucgaauuagugacaacaacaguaagcaauauggcagaaguacggucauauuguuacgaagcgaguaucucugacauggcaucagauaguagaugucccacacaaggggaagcuuauuuagauaaacaaucagauacacaauacguauguaaaagaacguuaguggaucgcggauggggaaauggauguggacuauucggcaaaggauccuuaguaacaugugcgaaauucgcaugcucaaaaaaaaugacaggaaaaucaauacaaccagaaaauuuagaauaucguauuaugcuaaguguacauggaucucaacacagcggaaugauaguaaacgauacuggacacgaaacagacgaaaauagggcaaaaguggaaauuacacccaauucaccaagagcagaagcuacuuuaggagguuuuggaaguuuagguuuagacugcgaaccgcguacaggauuagauuuuagugacuuauauuaucugacuaugaauaauaaacauugguuaguucauaaagaaugguuucaugauauaccacuuccuuggcaugcgggagcagacacaggaacaccacacuggaauaauaaagaagcauuagucgaauuuaaagaugcacaugcaaaaaggcaaacaguaguaguacuaggaucacaagaaggagcuguacauacagcacuagcaggagcauuagaagcagaaauggauggugcaaaaggaagacuuagcucuggacauuuaaaaugcaggcuaaaaauggacaaauugagauuaaaaggcguaucauauucguuauguacagccgcguuuaccuuuacaaaaauaccagcagaaacacuacacgguacaguuacaguagaaguacaauacgcaggaacagacggaccuuguaaaguaccagcacaaauggcagucgacaugcagacauuaacaccaguagguagacuaauuacagcaaauccaguaauaacagaaucuacagaaaacucaaaaaugauguuagaauuagaucccccauuuggagauaguuauauuguuauaggaguaggggaaaaaaaaauaacacaucauuggcacaggucagggaguacaauaggaaaagccuuugaggcaaccguaagaggagcaaaaagaauggcaguauuaggagauacagcaugggauuuuggaaguguaggaggagcgcuaaauagucuaggcaaaggaauucaucaaauuuucggagccgcauucaaaucauuauuuggaggaaugagcugguuuucucaaauacuaauugguacuuuauuaaugugguuaggauuaaacgcaaaaaauggaagcauaaguuugaugugcuuagcacuagguggaguauuaauauuucugagcacagcaguaagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11714 - RNA, 2314 nt, Artificial Sequence
  ZIKV (strain MR 766) prME-short variant mRNA Design 3 opt
gggagaaagcuuaccaugggaagaaaacaaaauaaaaggggugguaaugaagguucuaucaugugguuagcaucguuagcaguagugauagcuugugcaggagcuauaacaagacgaggaucagcauacuauauguacuuagacagaagugacgcaggaaaagcaauuucauuugcuaccacauuaggaguaaauaaaugccauguacaaauaauggauuuaggacacaugugugacgcaacaauguccuaugaaugcccuauguuggaugaagguguugaaccagaugauguugauugcugguguaauacgacaaguacuuggguuguuuauggaacaugccaucauaagaaaggagaagcaaggagaucaagacgagcagucacacuaccaucacacucaacaagaaaacuacaaacacgcucacaaacauggcuagaaagcagagaauauacaaaacauuuaauaaaaguggagaauuggaucuuuagaaauccaggguuugcgcuuguagcuguagcaauagcaugguugcuuggaaguucuacaagccaaaaaguuauauaucuaguaaugauauuauugauagcaccagcguauucaauaagauguauuggaguaagcaauagagauuuuguagaaggcaugucaggaggaacauggguagacguaguucucgaacauggaggcuguguaacaguaauggcacaagauaaaccuacgguggacauagaguuaguaacaacaacaguauccaauauggcugagguucgaucauauugcuacgaagcaagcauaucagacauggccagcgauucaagauguccaacucaaggggaagcauaucuugauaaacaaagcgacacgcaauacguauguaaaagaacucuaguagauaggggauggggaaaugguuguggauuauuuggaaaaggaucauuaguaacaugugcuaaauuuacauguucaaagaaaaugacaggaaaaaguauacaaccugaaaauuuggaauacagaauaauguuaagcguacauggaagccaacauucaggaaugaucggauaugaaacagaugaagauagagccaaaguagaagugacaccaaauucaccuagagccgaagcgacacuugggggauucggaagucuaggauuagacugugaaccuagaacaggacuagauuuuagcgaccuauauuauuuaacaaugaacaacaaacauuggcuaguacauaaagaaugguuccaugauauaccauuaccauggcacgcaggagcagauacuggaaccccacacuggaauaauaaagaggcccugguagaguucaaagacgcucaugcaaaaagacaaacaguggucguuuuaggaucacaagaaggagcgguacauacugcccuagcuggagcucuagaagcagaaauggauggagcuaaaggaagguuauuuucgggacauuuaaaauguagacuaaaaauggauaaauuacgacuaaaggguguauccuauaguuuauguacagccgcuuuuacauuuacuaagguuccggcagaaacauuacacgggacuguaacaguagaaguacaauaugcgggaacagauggaccguguaaaaucccgguucaaauggcaguagauaugcaaacauuaacaccaguuggaagauuaauaacagcuaacccagugauaacagaaaguacagaaaacagcaaaaugauguuagaauuagauccaccauuuggagauaguuauauaguuauaggaguaggagauaagaaaauaacacaccauuggcauagaucugguagcacaauaggaaaagcauuugaagcaaccguucgaggagcaaaaagaauggcaguauuaggagauacugcaugggauuuugggagcguaggaggaguauuuaacucauuaggaaaaggaauacaucaaauauuuggagcagcauucaaaucgcuauuuggaggaaugaguugguuuagccaaauacuaauugggacucuauuaguaugguuaggacuaaauaccaaaaauggaagcauaaguuuaacaugccuagcauugggaggaguaaugauauuuuuaagcacagccguuucagccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11715 - RNA, 2326 nt, Artificial Sequence
  ZIKV (strain NatalRGN) prME-short variant mRNA Design 3 opt
gggagaaagcuuaccauggguagaaaacaaaacaaaagagguggaaaugaaggaucaauaaugugguuagcuucacuagcagucguaaucgcuugugcaggagcuguaacuagaagaggaagugcauauuauauguaccuagauagaaaugaugcaggagaagcuauuaguuuuccaacaacacuagguaugaauaaaugcuauauacaaaucauggaucuaggacauaugugugaugcaaccaugucauaugaauguccuaugcuugaugaagguguugagccggaugacguggauuguugguguaauacuacgaguacauggguaguguauggaacaugucaucauaaaaaaggagaagcccgccgaaguagaagggcaguaacgcuaccaagucauucuacaaggaaacuacaaacaagaucacaaacaugguuggaaucacgagaauauacgaagcaucuuauuagaguugaaaauuggauuuucaggaauccaggauucgcuuuagcggcggcagcaauagcuuggcuacuaggaaguaguacuucacaaaaaguaauauauuuaguaaugauacuauugaucgcaccggcauacucaauaagauguauaggaguuucaaauagagacuuuguagaaggaaugagcgguggcaccuggguugauguuguauuggaacacggaggaugcguaacagucauggcacaagauaaaccaacaguagauauagaauuaguaacaacaaccguaaguaauauggcagaaguacgaucauauuguuaugaggcaaguauaucugauauggcuucagacucacguuguccaacucaaggcgaagcauaccuagauaaacaaucagauacucaauacguaugcaaaagaacauuaguagauagaggguggggaaaugguuguggauuauucggaaaaggaucauuaguaacuugugcaaaauucgcaugcaguaaaaaaaugacaggaaaaaguauacaaccagaaaauuuagaauacagaauaauguuaaguguacacggaagccaacauaguggaaugauuguaaaugauacuggacaugaaacggacgaaaaccgugcuaaaguagagauaacaccaaauagcccgagagcagaggcaacauuagguggauuugguaguuuagguuuagacugcgaaccucguaccggguuagacuuuagugacuuauauuauuuaacaaugaauaacaaacauugguuagugcauaaagagugguuccacgauauaccucucccuuggcaugccggagcugacaccggaacaccacauuggaacaauaaagaagcauuaguagaauuuaaagacgcacacgcaaaaagacaaacaguaguuguauuaggaucacaagagggugccguacauacagcacuugccggagcauuagaagcugaaauggauggagcuaaagguagacuuucaucaggacauuuaaaauguagauuaaaaauggauaaauuaagacucaaaggagucucauacagucuuuguacagcugcauuuaccuuuaccaaaauuccagcagagacacuacauggaacaguaacuguagagguacaauaugcaggaacagauggaccauguaaaguaccugcacaaauggcaguagauaugcaaaccuuaacaccaguaggaagauuaauuacagcuaaucccguaauaacugaaaguacagaaaacaguaaaaugauguuagaauuagauccaccauuuggugauagcuauauaguuauaggaguaggcgaaaaaaaaauaacucaucauuggcauagaagcgguagcacaauuggaaaagcauuugaagcaacuguaagaggagcaaaaagaauggcuguacuaggagauacagcaugggauuuuggaagcguuggaggagcacuaaauucauuaggcaaaggaauacaucaaauauuuggagcagcauucaaaagcuuauucggaggaaugucaugguuuucgcaaaucuuaauaggaacuuuacuaaugugguuaggacuaaauacuaaaaacggaucuauuagcuuaaugugcuuagcacuaggaggaguguuaauuuucuugucaacagcuguaagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11716 - RNA, 2299 nt, Artificial Sequence
  ZIKV (strain ZikaSPH2015) prME-short variant mRNA Design 3 opt
gggagaaagcuuaccaugaaugaaggaucuauaauguggcuagcuagucuugcugucguuauugcaugugcaggagcaguaacgcgaagagguucagcauauuacauguauuuagauagaaaugaugcgggagaagcaauaucauuuccaacuacauuaggaaugaacaaauguuauauccaaaucauggauuuaggccauaugugugaugcuacaaugucauaugaaugcccuaugcucgaugaaggaguagaaccagaugauguagauuguugguguaauacaacaagcacauggguuguauauggaacaugucaucacaaaaaaggagaagcgcgaagaucacgaagggcuguaacauuaccgucacauucaacacgaaaauugcaaacaagaagucaaacauggcuagaaucccgugaauauacaaaacauuuaauaagaguagaaaauuggauauucagaaauccagguuucgcauuagcagcggcugcaauagcaugguuauuagguaguagcacaagucaaaaaguaaucuaucuaguaaugauacuucuaauagcaccugcauauucaauaagaugcauaggcguuagcaauagagacuucguagaagggaugucagguggcacguggguagacauagugcuagaacauggaggauguguaacagucauggcccaagauaaaccuacaguagauauugaacuaguuacaacuacaguuucaaauauggcugaaguaagaucauauuguuacgaagcaaguauuucagauauggcaucagauaguagaugcccaacacaaggugaagcauaccucgauaaacaaagcgacacgcaauauguauguaaaagaacccuaguugacagagguuggggaaacggaugcggauuauuugggaaagguucacuaguaacaugcgcaaaauuugcaugcucaaaaaaaaugacaggcaaaucaauacaacccgaaaaucuagaauacagaauuauguuaucaguccauggaagucaacauucaggaaugauagucaaugauacaggacaugaaacagaugaaaacagggcaaaaguagagauaacuccaaacucaccuagggcagaagcaacuuugggagguuucggaagcuuaggauuagacugcgaaccuagaacagguuuagauuuuagcgacuuauacuaucuuacaaugaacaauaagcacugguugguacauaaagagugguuucacgacauaccuuuaccauggcacgcaggugcagacacaggaacaccucauuggaauaauaaagaagcauuaguagaauuuaaagaugcacaugcaaaacgucaaacgguagucguacuaggcucccaagaaggagcgguacauaccgcacuugcaggcgcauuagaagcagaaauggauggagcaaaaggaagacuaagcucaggucaucuaaaauguagauugaagauggauaaauuaagauuaaaagggguuaguuacucguuauguacagcagcauuuacauucacaaaaauaccagcggaaaccuuacacggcacuguaacggucgaaguucaguaugcaggaacugaugguccauguaaaguaccagcacaaauggcaguagauaugcaaacauuaacaccuguaggaagguuaauuacugccaacccaguaauaacagaaaguacagagaauucaaaaaugaugcuagaacuagauccuccguucggagacaguuauauaguaauaggaguaggagaaaaaaaaauuacacaucauuggcauagaaguggaucaacaauaggcaaagcauucgaagcuacaguuagaggugcaaaaagaauggcaguacuaggcgacacagcaugggacuuuggaucaguugggggagcucuaaacagcuuaggaaaaggcauacaccaaauauucggagccgcuuuuaaaagucuguuuggaggcaugagcugguuuucacaaauucuuauaggaacauuguuaaugugguuaggauuaaauacgaaaaauggaucaauaucauuaaugugcuuagcacucggaggcguauuaauuuuuuuaucgacagccguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11717 - RNA, 2299 nt, Artificial Sequence
  ZIKV (isolate Z1106033) prME-short variant mRNA Design 3 opt
gggagaaagcuuaccaugaaugaaggaaguauaaugugguuagcuagucuugcaguaguaauagcuugcgcaggagccguaacaagaaggggaagugcauauuauauguacuuagauagaaacgaugcuggagaagcaauaaguuuuccaacaacauuaggaaugaacaaauguuauauacaaauaauggacuuaggucauacaugugaugcaacaauguccuaugaauguccuaugcuugacgaaggaguagaaccagaugauguagacuguugguguaacacaaccucuacauggguaguuuacgguaccugucaucauaaaaaaggggaagcaagaagaagccgucgugcaguuacacucccaagccacagcacuagaaaauuacaaacaagaagucaaacuugguuagaaucaagggaauacacaaaacacuuaauuagaguggaaaauuggauauucagaaauccuggauuugcucuggccgcugcagcaauagcuuggcuauuaggaucaagcacuagucaaaaaguuauauaucuaguaaugauauuacucauagcaccagcauauucaauaagauguauagguguaucaaacagggacuucguagaaggaaugagugguggaacauggguagauguaguacuagaacacggaggcugcgucacaguaauggcucaagauaaaccaacaguagauauagaacucguuacgacaacaguaaguaauauggcagaaguuagaaguuauuguuaugaagcaucaauaagugauauggcaagugacagcagaugcccaacacagggugaagcauaucuagacaaacaaucugauacacaauauguuugcaaaaggacauuaguugauagaggaugggguaauggauguggauuauuugguaaaggaaguuugguaaccugcgcaaaauucgcuuguucgaaaaaaaugaccggaaagucaauacagcccgaaaaccuagaauauagaauaaugcuuucaguacacggaucacagcauaguggcaugauagugaaugacacaggucaugaaacagacgaaaauagagcaaaaguagaaaucacaccaaauucaccacgagcugaagcaaccuugggaggauuuggcagcuuaggacuagauugugaaccaagaacuggauuagauuuuucagaucuauauuacuuaacaaugaacaacaaacauugguuagugcacaaagaaugguuucacgacaucccacuacccuggcacgcuggugcagacacagggacuccucauuggaacaacaaagaagcauuaguagaauuuaaagaugcucaugcaaaaagacaaaccguuguaguccuuggaagucaagaaggcgccguacacacagcauuagcuggagcacuagaagcggaaauggauggagcaaaaggaagacuaucaucaggacaucuaaaauguagauuaaaaauggauaaauuaagacuaaaagguguaaguuacaguuuauguacagcugcauuuaccuucacuaaaauucccgcagaaacacuccacggaacaguaacaguagaagugcaauacgcuggaacagauggaccauguaaaguaccugcacaaauggccguagacaugcaaacauuaaccccaguaggcagauugaucacagcuaacccaguaauaacugaaagcacagaaaauagcaaaaugauguuagaacuugauccuccguuuggcgauaguuauaucguaauagggguaggagaaaaaaaaauuacacaucauuggcauagaaguggaaguacaauaggaaaagcauuugaagcaacuguaagaggugcaaaaagaauggcaguauuaggugauacagcgugggauuuuggaucaguuggaggagcauuaaauaguuuaggaaaagguauacaucaaauauuuggagcugcguucaagucacuauuuggaggaaugaguugguuuagccaaauacuaauagguacgcuacuaaugugguugggcuuaaacgcaaaaaacggaaguauuucacuaauguguuuagcacuaggaggagugcuuauauuucuuaguacagcaguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11718 - RNA, 2287 nt, Artificial Sequence
  ZIKV (strain MR 766) prME-short variant mRNA Design 3 opt
gggagaaagcuuaccaugaaugaaggaucuauuaugugguuagcaucacuagcggugguaaucgcaugcgccggcgcaaucacaagaagaggaucagcauauuauauguaccucgaucgaucagaugcuggaaaagcaauaucauucgcaacaacauuaggaguuaauaaaugccauguacaaauuauggacuuaggacauaugugcgaugcaacuaugucauaugaauguccaaugcuagaugaaggaguggaaccagaugauguagauuguugguguaacacaacaagcacauggguaguuuacggaacuugucaucauaagaaaggagaagcgcgacgaucaaggagagcaguuacacuaccaagucacaguaccagaaaacuacagacaagaucacaaacaugguuagagaguagagaauauacgaaacaccucauaaaaguagaaaauuggauauucagaaauccaggauuugcucuaguugcagucgcaauagcaugguuauuaggaucaaguacgagucaaaaaguaauauacuuaguaaugauauuacuaauagcaccagcauauucuauuagaugcaucggaguuucaaauagagauuucgucgagggaaugucaggaggaacuuggguagaugugguauuagaacacggaggaugcguaacaguaauggcacaagacaaaccaacagucgauauagaauuagugacaacaacaguaagcaauauggcagaaguaagaucauauuguuaugaagccucaauaagcgauauggcgucagauucaagaugcccaacacaaggagaagcauacuuagacaaacaaucugacacacaauaugucugcaaaagaacucuagucgacaggggcugggguaacggaugcggauuauucgguaaaggaucauuaguaacaugugcaaaauucacauguaguaagaaaaugacuggcaaaagcauucaaccagaaaaucuagaauacaggauaaugcuaucaguacacggaagccaacacagcggaaugauaggauacgaaacagaugaagauagagcaaaaguagaaguaacaccgaacaguccacgagcugaagcgacauugggcggguucggaucauuaggauuagauugugaaccgagaacagguuuagauuuuagcgaccuguauuacuuaacaaugaauaauaaacauuggcuaguacauaaagaaugguuccaugauauaccacugccauggcaugcaggggcagauacagguacaccacacuggaauaacaaagaagcauugguagaauuuaaagaugcacaugccaaacgacaaacgguagugguauuagggucacaagagggagcuguacauacagcauuagcaggagcacuggaagccgaaauggauggugcaaaaggaagauuguucaguggacaucuaaaaugcagauugaaaauggauaaacuacgauuaaaagggguaucauauucacuauguacagcagcauuuacauuuacaaaagugccagccgaaacuuugcaugguacaguaacaguagaaguacaauaugcagguacagauggaccauguaaaauaccuguucagauggcagucgacaugcaaacacuuacaccuguuggaaggcuuauaacagcaaauccagugauaacagaaucaacagaaaauagcaaaaugaugcuagaacuagauccacccuuuggagauucauacauaguaauuggggucggagauaagaaaauaacucaucauuggcauagaucuggaagcacuauaggaaaggcuuucgaagcaacaguaagaggagcaaaaagaauggcaguauuaggagauacagcaugggauuuuggaagcguagguggaguauuuaauucguuaggaaaaggaauccaucaaauuuuuggagcagcauucaaaagucuauuuggagguaugucuugguuuagccaaauauuaauagguacauuacuuguauggcuaggacuaaauacuaaaaacgggucuauaaguuuaacaugcuuagcacuaggagggguaaugauauuuuuaagcacagcaguaagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11719 - RNA, 2299 nt, Artificial Sequence
  ZIKV (strain NatalRGN) prME-short variant mRNA Design 3 opt
gggagaaagcuuaccaugaaugaaggaucaauaauguggcuagccaguuuagcgguaguaaucgcaugugcuggagcaguaacaagaagaggaagcgcuuacuauauguauuuagacaggaacgaugcaggugaagccauaaguuuucccacaacacuaggaaugaacaaauguuauauucaaauaauggaucuaggacauaugugugaugcuacuaugaguuaugagugcccaaugcuagacgagggaguggaaccugaugacguagacugcuggugcaauacaacaagcacauggguaguuuauggaacaugucaccauaaaaaaggagaagcucggcgaucaagaagagcaguaacauuaccuagucauaguacgagaaaacuacaaacaaggagccaaacaugguuagaaucacgugaauacacaaaacauuuaauaagaguagagaacuggauauuuagaaacccaggcuuugcacuagcagcagcagcaauagcaugguuauuaggaucaucgacaagccaaaaaguaauauaucuagugaugauauuacuaaucgcaccagcauauagcauaagauguauaggaguuagcaauagagacuucguagaaggaaugucaggcggaacauggguagauguaguuuuagaacauggaggauguguaacaguaauggcucaagacaaaccaacagucgauauugaacuaguaaccacgacaguaagcaacauggcugaaguacgaucauauuguuaugaggcaagcauauccgacauggcaucggacucaagauguccaacacaaggugaagcauauuuggauaaacaaucagauacacaauauguguguaaaagaacuuuaguugaucgcggaugggguaacggaugugguuuauuuggaaaaggaucacuaguuacaugugcaaaauucgcaugcaguaaaaaaaugacgggaaaaagcauacaaccggaaaaucuagaauauagaauaauguugaguguacauggaucacaacauaguggaaugauaguaaaugauacaggccacgaaacagaugaaaauagagcaaaaguugaaauuacaccaaauagcccacgagcagaagcaacacuagggggauucggaagucuaggguuagacugcgaaccaagaacggguuuggauuuuagugaucuauauuaucuuaccaugaauaacaaacauuggcucguacauaaagaaugguuucaugauauaccauuacccuggcaugcaggagcagauaccgguacgccucauuggaauaauaaagaagcauugguagaauucaaggaugcacacgcgaaaaggcaaacuguaguaguauuaggaagccaagaaggagcaguacacacagcauuagcuggugcacuagaagcugaaauggauggagcaaaaggaagauuaaguucaggucauuuaaaauguagauuaaagauggauaaauuaagauuaaaagggguaaguuacucauuauguacugcggcauuuacauuuacaaaaauaccagcagagacucuacaugguacaguaacaguugaagugcaauaugcagguaccgauggaccauguaaaguaccagcacaaauggcaguugauaugcaaacacuuacaccagucgggagacuaauaacugcaaacccaguaauaacagaaucaacagaaaacaguaaaaugaugcuagaauuagauccaccauuuggagacaguuauauaguaauaggaguaggugaaaaaaaaauuacacaccacuggcacagaucaggaaguacgauaggaaaagccuuugaagcgacagugagaggagcaaaaagaauggcaguauuaggagacacagcaugggauuuugguaguguuggaggcgcucuaaauucacuagguaaaggaauacaucaaauauuuggagcagcauuuaaaagccuauuuggagggaugucaugguucagucaaauucuaauaggaacacuauuaaugugguuaggacuaaauacaaaaaacggaucaauaucuuuaaugugucuagcauuaggaggcguauuaauauuucuuagcacagcgguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11720 - RNA, 2326 nt, Artificial Sequence
  ZIKV (strain ZikaSPH2015) prME-short variant mRNA Design 3 opt
gggagaaagcuuaccaugggaaggaaacaaaauaaaagaggugguaaugaaggaucaauaaugugguuagcaucacuagcagucgucauagcuugcgcgggagcaguaacuagaagaggaucggcuuacuacauguauuuagauagaaaugaugcaggagaagcuauaucuuucccgacaacacucggaaugaauaaauguuauauccaaauuauggaucuuggacauaugugcgaugcaacaaugagcuaugaauguccaauguuagaugaggguguugaaccggaugauguagauuguuggugcaauacaacaucaacauggguaguauacggaacaugucaccauaagaaaggagaagcuagaagaagcagacgagcaguaacacuaccaagucacucaacaagaaaauuacaaaccagaagucaaacuugguuagaaagucgagaauauacaaaacaucuuauacggguagaaaauuggauauuuagaaauccuggauucgcacuugcagcggcagccauagccuggcuauugggcagcaguacaagccaaaaaguaauuuaucuuguaaugauauuauuaauagcuccagcauauagcauuagauguauaggaguaagcaacagagauuuuguagaaggaaugucaggaggaacauggguugauauaguauuagaacacggugguuguguaacaguaauggcacaagauaaaccuacaguagacauugaacuuguaaccacaacaguuaguaauauggcagaaguaagaucauacuguuaugaagcuaguauaucagauauggcaagugacucaagauguccaacacaaggagaagcauauuuagacaaacaaucagauacacaauacgugugcaaaagaacauugguagacagaggaugggggaauggauguggauuauucggaaaaggaucauuaguaaccugugcaaaauuugcauguaguaagaaaaugacagguaaaucaauacaaccugaaaaucuagaauauagaauaaugcuauccguacacggcagccaacacuccggaaugauaguaaaugacacuggacaugagacugaugaaaaucgagcaaaaguagaaauaacaccuaauagccccagagcagaagcaacauugggaggauuugguagcuuaggauuagacugcgaaccuagaacuggcuuagauuuuuccgacuuauauuauuuaacaaugaauaauaaacauugguuaguacauaaagagugguuucaugacauaccacuaccguggcacgcaggagcagauacaggaacuccacauuggaacaauaaagaagcccuaguagaauuuaaggacgcacaugcaaaaagacaaacaguaguaguuuuggggucacaagaaggagcaguacauacagcauuagcaggcgcacuagaagcugaaauggauggcgcaaaaggacgauugagcucaggucauuuaaaaugcagacuuaaaauggauaaauuaagacugaaaggggugucuuauucgcuauguacagcugcauuuacauucacaaaaauaccagccgaaacauuacacggaacagucacaguagaaguucaguaugcuggaacugacggcccauguaaaguuccagcacaaauggcaguagauaugcaaaccuuaacaccuguaggaagguuaauuacagcaaauccaguaauaacagaaucaacagaaaauaguaaaaugauguuagaauuagacccaccuuuuggagauaguuacauaguaauuggagucggagagaagaaaauuacacaucacuggcacagaagcggaagcacauuaggaaaagcauuuagcacaacguuaaaaggagcacaaagauuagcugcauuaggagauacagcaugggauuucggaucaaucggaggaguuuucaauaguauagggagagcaguacaccaaguauucggaggagcauucagaacacuauucggaggaaugaguuggauaacacaagguuuaaugggagcacuacuauuauggaugggcguaaacgcccgcgaccgaucuaucgcauuagcauucuuagcaaccggcggcguacuuguuuuccuagcaacaaacguacaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11721 - RNA, 2326 nt, Artificial Sequence
  ZIKV (isolate Z1106033) prME-short variant mRNA Design 3 opt
gggagaaagcuuaccaugggaagaaaacaaaauaaaaggggagguaaugaaggaucaauaaugugguuagcaaguuuagcuguaguaauagcaugugcaggagcaguaacaagaagagguagcgcauacuacauguauuuagacagaaacgaugcaggagaagcaauuuccuuccccacaacuuuaggaaugaauaaauguuauauacaaauaauggauuuaggacacacaugugaugcuaccaugucauaugaaugucccaugcuagaugaaggaguagaaccagacgacguugauuguugguguaauacaacaaguacuuggguuguauaugggacaugucaucauaagaaaggcgaagcucgaaggucaagacgagccguaacauugccgagucauucaacaagaaaauuacaaacgagaucacaaacauggcucgaaucaagagaauacacaaaacacuuaauaagaguugagaacuggauauucagaaauccugguuuugcauuagcagcagcugccauagcauggcuauuaggaaguagcacaucucaaaaaguuauauacuugguaaugauucuauuaauagcuccagcauauucuauaagauguauaggaguuaguaaccgagacuuuguagaaggaaugagcggaggaacguggguagacguaguauuagaacauggaggaugcguaacaguaauggcacaagauaaaccaacagucgauauagaauuaguaacaacaacaguaucaaauauggcggaaguaaggaguuauuguuaugaagcaucaauaagugacauggcaagugauaguagaugucccacacaaggugaagcguauuuagauaaacaaagugauacacaauauguuugcaaaaggacauuaguagauaggggauggggaaacgguuguggauuauuugguaaaggaagucugguaacaugugcaaaauucgcuugcucaaagaaaaugacaggaaaaucuauacaaccagaaaauuuagaauacagaauaauguuaagcguacauggaagucaacacucaggaaugauagucaaugauacaggucaugaaacagaugaaaacagagcaaaaguagaaauuacaccaaauucaccgagagcagaagcgacauuagguggauucgggaguuuaggccuagacugugagccccgaacaggucuagauuuuucagauuuguauuaccuaaccaugaauaauaaacacuggcugguacauaaagaaugguuccacgauauaccacuuccauggcaugcaggagcagacacaggaacaccacauuggaauaacaaagaagcauuaguggaguucaaagacgcucaugcuaaaaggcaaacuguuguuguuuuaggaagucaagaaggagcuguacacacggcacuagcgggugcauuagaagcagaaauggauggagcaaaagguagacuaucaucaggacacuuaaaaugccgguuaaaaauggauaaacuaagauuaaaaggagucaguuauucauuaugcacugcagcuuuuacauucacuaaaauuccggcagaaacacuacauggaacagucaccguagaaguacaauaugccggaacagauggacccuguaagguuccggcacaaauggcaguagauaugcaaaccuugaccccaguaggaagauuaauaacagcaaacccaguaauaacggaaaguacagaaaauucaaagaugaugcucgaauuggauccaccauuuggagauucauauauaguuauuggaguuggagaaaagaaaauuacacaccauuggcauagaaguggaucaacauuaggaaaagcauuuucgacaacauuaaaaggagcacaaaggcuagcagcauuaggagauacagcaugggauuuuggcaguauugguggaguguuuaauucgauaggcagagcaguucaucaaguauuuggaggagcauucagaacauuguucggaggaaugaguuggaucacccaaggauuaaugggagcauuacuacuauggaugggagucaaugcaagagauagaagcauagcauuggcuuuucuggcuacaggaggaguucuaguauuuuuagcaacaaacguacaugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11722 - RNA, 2314 nt, Artificial Sequence
  ZIKV (strain MR 766) prME-short variant mRNA Design 3 opt
gggagaaagcuuaccaugggacguaaacaaaauaaacgaggaggaaacgaagguucaauaauguggcucgcaagucuagcaguaguaauagcaugugcaggagcaauaacaagaaggggaucugcauacuacauguauuuagacagaucagacgcaggaaaagcaauaaguuuugcuacaacauuaggaguaaauaaaugucacguacaaauaauggaccuaggacacaugugugaugcuacaaugucauaugaauguccuaugcucgaugaaggaguagaaccugaugacguggauuguuggugcaacaccacaagcacauggguaguauacggaacaugucaucacaaaaaaggagaagccagaagaagcagaagggcaguuacauugccgagucauuccacaaggaaauuacaaacaagaucacagacuugguuagaaaguagagaauacacaaaacauuugauaaaagucgaaaauuggauuuuccgaaauccaggauuugcauuaguagcaguagcaauagcaugguuauugggaagcagcacaagucaaaaaguaauauaccuuguuaugauacuacuaauagcuccagcuuacucuauacgauguauugguguaagcaauagagauuuuguagaaggaaugucaggaggaacauggguagacgugguacuagaacauggaggcuguguaacgguaauggcacaagauaaaccgacaguagauauagaauuaguaacaacaacugugaguaauauggcagagguaagaaguuauugcuaugaagcaucuauaagcgacauggcaucagauucgagaugccccacacaaggagaagcuuauuuagacaaacaaucagacacacaauacgucuguaaacggacgcuagucgacagggguugggguaaugguugcggucuauuuggcaaaggaucauuaguaacaugugcuaaauuuacuuguucuaaaaaaaugacaggaaaauccauucaaccagaaaauuuagaauauagaauaaugcuaucaguacaugguagucaacauaguggaaugauaggauaugagacugaugaagauagagcuaaaguugaaguaacaccgaacaguccacgagcagaggcaacacuaggaggauuuggaucauuaggacucgauugugaaccaagaacaggauuagauuuuucagaucuauauuacuuaacaaugaauaauaaacauugguuaguacauaaagaaugguuucaugauauaccacuaccuuggcaugcgggagcagacacgggaacuccacacuggaauaacaaagaagcacuuguagaauucaaagacgcacaugcaaaacgacaaacagugguaguauuaggaucacaagagggugcaguacauacagcuuuagcaggagcacuagaagcagaaauggacggugcaaaagguagauuauucucuggucacuuaaaaugcagauuaaaaauggauaaauuaagauuaaaaggaguuaguuauucauuauguacagcggcauuuacauuuacuaaaguaccagcugaaacauuacacgguacagucacaguugaaguacaauaugcaggaacugauggcccuuguaaaauaccaguacagauggcaguagauaugcaaacauugacaccaguaggacgcuuaauuacagcaaauccaguuauuaccgaaucaacagagaauucaaaaaugauguuagaauuagauccucccuuuggagauagcuauauuguuauaggcguaggugauaaaaaaauaacacaucauuggcaucgaucaggaaguacuuuaggaaaagcauucucaacaacuuuaaaaggagcacaaagguuagcagcacuaggcgauacugcaugggacuucggaucuauaggagguguauuuaauagcaucggcagggcaguacaucaaguauuuggaggagcuuuuagaacacuauucggggguaugaguuggauaacacaaggacuaaugggcgcauuacuauuauggaugggaguaaaugcuagagaucguucaauagcacuagcauuuuuagcuacagggggaguauuaguauuuuuagcaacuaauguacacgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11723 - RNA, 2326 nt, Artificial Sequence
  ZIKV (strain NatalRGN) prME-short variant mRNA Design 3 opt
gggagaaagcuuaccaugggccggaaacaaaauaaaagagggggaaaugaaggaucgauaauguggcuagccucauuagcaguuguaauagcaugcgccggugcgguaacacgaagaggaagugcuuacuauauguaccuagaccgaaaugaugcgggagaagcuauuaguuuuccaacaacacugggaaugaauaaauguuacauacaaauaauggaccuaggacacaugugcgaugcuacaaugaguuaugaauguccaauguuagaugaggguguagaaccagaugacguagauuguugguguaauacaacaaguacauggguaguauauggaacaugucaucacaagaaaggcgaagcaagaagaucaagacgagcaguaacauuaccaucacauucuaccagaaaauuacaaacaaggagucaaacuuggcuagagucuagagaauauacgaaacaucuaauacgaguagaaaauuggauauuuagaaauccaggauucgcauuagcagcugcagcgauagcauggcuacucggauccucaacaucacaaaaaguaauuuacuuagugaugauacuauuaauagcaccagcauauagcauuagguguauaggaguaagcaauagagauuuuguagaaggaaugaguggaggaacaugggucgacguaguauuagaacauggcggauguguaacaguaauggcacaagauaaaccaacaguagauauagaauuaguaacuacaacaguuucaaauauggcagaaguacgaucuuacugcuaugaagcaaguauuucugauauggccucagacaguagaugccccacccaaggugaagccuaucuggauaaacaaucagauacccaguacgucuguaaaagaacccuaguagauagaggauggggaaauggauguggauuauucggaaaagggaguuuaguaacaugugcaaaauuugcaugcucaaagaaaaugacuggaaaaucaauacaaccugagaacuuagaguacagaauaauguuaaguguccauggaucacaacauagugguaugauugugaaugacacaggucaugaaacagaugaaaaucgagcaaaaguagaaauaacaccaaauucaccaagagcagaggcuacauuaggagguuuuggaucguuaggacuagacugcgaaccaagaacaggacuagacuuuagugaucuauacuaucuuacuaugaacaauaaacauuggcuaguucacaaagaaugguuucaugacaucccccuacccuggcaugcaggagcugauacaggaacaccacauuggaauaauaaagaagcguuaguugaauuuaaagaugcacacgcaaaacgacaaacaguggugguauuaggaucccaagagggagcuguacauacagcacuugcaggagcacuagaagcagaaauggauggagcaaaaggaagguuaagcaguggccauuuaaaauguagacuaaaaauggauaaauuaagauuaaaagguguaucauauagcuuauguacagcagcauucacuuuuacaaaaauacccgcagaaacccuucacggaacagucaccguggaaguacaauacgcaggaacugacggaccauguaaaguaccugcucaaauggcuguagauaugcaaacucuaaccccaguuggaagauuaauuacagcaaauccaguuauaacagagucaacagaaaauucaaaaaugaugcuagaauuagauccaccauuuggugauaguuacauagugauaggaguaggagaaaagaaaauaacgcaucauuggcauagaucgggaucaacacuuggaaaagcauuuaguacaacccuaaaaggagcacaaagauuagcagcauuaggggauacugcaugggacuucgguagcauaggagguguauucaauagcauaggcagagcaguacaccaaguauucggaggagcauucagaacauuauucggaggaaugucauggauaacacaaggauuaaugggagcauuauuauuguggaugggaguaaacgcaagagacagaagcauagcauuagcauuccuagcaacaggaggaguuuuaguuuuccuggcaacaaacguacaugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11724 - RNA, 2299 nt, Artificial Sequence
  ZIKV (strain ZikaSPH2015) prME-short variant mRNA Design 3 opt
gggagaaagcuuaccaugaaugaaggauccauaaugugguuagccaguuuagcuguaguaaucgccugcgcuggagcaguuacacggcgaggaucagcauauuauauguauuuagacagaaacgaugcuggagaagcaauaucauuuccaacaacacuaggaaugaauaaauguuauauacaaauaauggauuugggacauaugugugacgcaacaaugaguuaugaauguccaauguuagaugaaggagucgaaccagaugauguagacugcugguguaauacaacaucaacauggguuguuuauggaacaugucaccauaagaaaggagaggcaagaagaaguaggagagcaguaacucuuccaagucacucaacucgaaaacuacaaacacgaucacaaacaugguuagaaucuagagaauauacuaaacauuugauaagaguagaaaacuggauauucagaaaucccggauuugcacuagcagcagccgcaauagcaugguuacuaggaucaaguacuucacaaaaaguaauauauuugguuaugauucuguuaaucgcuccagcauauaguauaagauguauaggagucagcaacagagauuuugucgaagguaugucaggagguacauggguugacaucguacuagaacacggcgguuguguaacgguaauggcacaagauaaaccaacaguagauauagagcuaguaaccacaacaguaucaaauauggcugaagugaggucauauuguuaugaagcaucuauuagugauauggcaucagauagucgauguccuacacaaggagaagcauauuuagauaaacaaucagacacacaauacguuuguaaaagaacucuaguagacagaggauggggaaacggauguggacuauuuggaaaaggcagccuaguaacaugcgcaaaauuugcaugcucaaagaaaaugacuggaaaaucaauacaaccagaaaauuuagaauaucgcauaaugcuuagcguacaugggucacaacacucaggaaugauaguaaacgacacuggacaugaaacugacgaaaacagagcaaaaguggaaauaacaccuaauaguccaagagcagaagcuacucuaggaggauucggaagucuaggcuuagauugugaaccuagaacgggacuagacuucucugaucuauauuacuuaacaaugaauaacaaacacuggcuuguucauaaagaaugguuucacgauaucccauuaccauggcaugcaggagcagauacaggaacaccacauuggaauaacaaagaagcauuaguagaauuuaaggaugcacaugcuaaaagacaaacaguaguaguacuggguucacaagaaggagcaguccacaccgcauuagcaggagcuuuagaagcagaaauggauggagcaaaaggacgacucucaucuggacaucuuaaaugcagacuuaagauggauaaacuaaggcuaaaaggaguaaguuauucauuauguacagcugcauuuacauuuacaaaaauacccgcagaaacauuacauggaacagugacuguagaaguacaauaugcaggcacagaugguccguguaaggucccugcacaaauggcaguugauaugcaaacauuaacaccagucgguagacuaauaacagcaaaucccguaauaacugaaucaacugaaaauucaaaaaugauguuggaauuagauccacccuucggagacucauacauuguaauaggagucggugagaagaaaauaacucaccauuggcacagaaguggaagcacacuagguaaagcauuuucaacaacauuaaaaggcgcacaaaggcuagccgcacuuggugacaccgcgugggauuuuggcucaauagguggaguauuuaauaguauaggucgugcuguacaccaaguauuuggaggcgcauuucgaacucuauuugguggaauguccuggauaacucagggacuaaugggagcacuacuacucuggaugggaguuaaugcaagagauaggucaauagcuuuagcguuucuagcaacaggugguguacucguauuccuggcaacaaacguacaugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11725 - RNA, 2299 nt, Artificial Sequence
  ZIKV (isolate Z1106033) prME-short variant mRNA Design 3 opt
gggagaaagcuuaccaugaaugaagguaguauaaugugguuagcaaguuuagcaguaguaauugccugugcaggagcaguaacaaggagaggaagugcauauuauauguaucuggacagaaaugacgccggagaagcgauuaguuuuccaaccacgcuaggaaugaacaaauguuacauacagaucauggauuuaggacauacaugugacgcaacaaugucauacgaaugcccaaugcuagaugaaggaguagaaccugacgauguagacuguugguguaauacuacuucaaccuggguaguauauggaacaugucaccacaagaaaggagaagcaagaagaucaaggagagcagucaccuuaccaucacauagcacaagaaaauuacaaacaagaucucaaacuuggcuugagagcagagaauacacaaaacauuuaauaagaguagaaaauuggauauuuagaaauccaggauuugcuuuagcagccgcagcgauagcaugguuacuaggaagcucaacaucccaaaaaguuauauauuuaguaaugauauuauuaauugcuccugcauauucgauaagauguauuggaguaucaaauagagauuuugucgaaggaaugagcggagggacauggguagauguuguacuagaacacgguggaugcguuacaguaauggcacaagauaaaccaacagucgauauagaauuaguuacaaccacaguaaguaacauggcagaaguaagaucguauuguuaugaggccuccauuucagauauggcaucugauucacgaugcccaacacaaggagaagcauaucuugauaaacaaucagauacccaauauguuuguaaaagaacuuuaguugacagagguuggggaaauggcuguggucuauucggcaaaggaagccuaguaacaugugccaaauucgcauguucgaagaaaaugacuggaaaaucuauucaaccugaaaacuuagaauauagaauuauguuaucagugcaugguucacaacacaguggaaugauaguaaaugacacaggacaugaaacagaugaaaacagggcaaaaguagaaauaacaccaaauucacccagagcugaagcuacauuagguggauuuggaagucucggacuagauugcgaaccaagaacaggauuagauuuuagugaucuauauuaccuaacaaugaacaacaaacauuggcuuguucacaaagaaugguuccacgauauuccccuacccuggcaugcaggagcagacacagguacaccucauuggaauaauaaagaagcauuaguagaauuuaaagaugcacaugcaaaaagacaaacaguaguaguacuaggaucucaagaaggugcaguacauacugcccuagcaggagcccucgaagcggaaauggauggagcaaaaggaagauuaucaucuggccaucuaaaaugcagauuaaaaauggacaaacuaagacuuaaaggaguaaguuauagucucuguacagcagcauuuacauuuacaaaaauuccagcagaaacuuuacaugguacuguaacaguagagguucaauaugcaggaacagauggaccauguaaaguccccgcacaaauggcgguggacaugcaaacacuaacuccaguaggaagacuaauaacagcaaauccaguaauaacagaaucaaccgaaaacucgaaaaugauguuagaauuagacccaccuuuuggugauagcuauauuguaauagguguaggagagaaaaagauaacacaccauuggcauagaagugggucaacacuaggaaaagcauuuagcacaacacuaaaaggcgcacaaagauuggcagcauuaggugacacagcuugggacuucggcagcauaggaggaguauuuaauucaauuggcagagcaguacaccaaguauuugguggagcuuuuagaacuuuauucgguggaaugaguuggauuacacaagguuuaaugggagcuuuacuacuauggauggguguaaaugcaagagauaggagcauagcauuagcauuucuagcaacagguggagugcuaguauucuuagcaacgaacguacaugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11726 - RNA, 2287 nt, Artificial Sequence
  ZIKV (strain MR 766) prME-short variant mRNA Design 3 opt
gggagaaagcuuaccaugaaugaaggcucaauaauguggcuagcaucacuagcaguaguaauagcaugcgcuggagcuauaacuagaagaggaucagcuuacuacauguauuuagauagaagugacgcagguaaagcaauaucauuugcaacaacacuaggagucaacaaaugucauguacaaauaauggauuugggacacaugugugaugcaacaaugagcuacgaaugcccaauguuggacgaaggaguagaaccugaugauguugacuguugguguaauacaacaagcacuugggucguauaugguacaugccaucauaagaaaggagaagcaagacgaucuagacgagcaguaacacuuccgagucauucuacaagaaaauuacaaacgagaagccaaacuuggcuagaaucuagagaauauacaaaacaucuaauaaaaguagaaaauuggauauuuagaaauccaggauucgcauuaguagcaguggcaauugcauggcuauugggaagcaguacgagccaaaaaguaauauaucuaguaaugauauuacuaauagccccugcuuacagcauaagaugcauaggaguaucuaauagagauuuuguugaaggaaugucuggagguacuugggucgacguaguguuagaacauggaggauguguaacaguaauggcacaagacaaaccaacaguagacauagaauuagucacuacaacuguaucgaauauggcugagguaagaagcuauuguuaugaagcaagcauaagugauauggcauccgacaguagauguccaacucaaggagaagccuaucuagauaaacaaagugauacgcaauauguauguaaaagaacccuaguagacagaggguggggaaauggauguggauuauuuggaaaaggaagucuuguaacaugcgcaaaauucacauguucaaagaaaaugaccggaaaaagcauucaaccugaaaaucuagaguaucgaauaauguuaucuguacauggaucacaacauucaggaaugauaggauacgaaacggacgaggauagagcaaaaguagaaguaacaccaaauaguccaagggcagaagcuacauugggaggauuuggcagcuuaggauuagauugcgaaccacgcacaggauuagauuuuagcgauuuauauuauuuaacaaugaauaauaaacauuggcuaguacauaaagaaugguuucaugauauaccucuaccauggcacgcuggagcagauacaggaacaccacauuggaacaacaaagaggcgcuuguagaguucaaagacgcacacgcgaaaagacaaacaguaguuguuuuaggaagucaagaaggagcuguacacacagcauuagcaggagcuuuagaagcagaaauggacggagcaaaaggaagauuguuuaguggucaucuaaaauguagacuaaaaauggacaaauuaagauuaaaaggugucaguuauucauuauguacagcugcauucacauuuacaaaaguuccugcggaaacuuuacauggaacugucacugucgaaguacaauacgcgggaaccgauggacccugcaaaauaccuguacaaauggcuguagacaugcaaacauuaaccccaguaggaagauuaauaacagcaaauccaguaauaacagaaaguaccgaaaauucaaaaaugauguuagaacucgacccacccuuuggagauucauacauagucauaggaguaggagauaagaaaauaacacaucauuggcaucgaaguggcucaacacuagggaaagcauuuucaacuacgcuuaaaggugcacaaagauuagcagcuuuaggugacacagcaugggauuuuggaagcauaggaggaguauuuaacucaauagguagggcuguacaucaaguauuuggaggugcguuucgaacauuauucggaggaaugaguuggauaacucaaggauugaugggggcuuuacuguuauggauggguguaaaugcuagagauagaaguauugcauuggcauuuuuagcaacuggaggaguguuaguguuuuuagcaacaaauguacaugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11727 - RNA, 2299 nt, Artificial Sequence
  ZIKV (strain NatalRGN) prME-short variant mRNA Design 3 opt
gggagaaagcuuaccaugaaugaaggaaguaucaugugguuagcaaguuuagcaguaguaauugcaugcgcaggggcaguuaccagaagaggcagcgcuuacuauauguacuuagacagaaacgacgcaggagaagcgaucucauucccaacaacauuaggaaugaauaaauguuauauucaaauuauggacuuaggacacaugugugaugcuaccaugucauaugagugcccaaugcuugaugaaggaguggagccagacgacguugauuguuggugcaauacaaccucaacuuggguuguauauggaacaugucaucauaaaaagggagaagcaagaagaucaagaagagcaguaacacuaccuucacauucaacaagaaaauuacaaacacguucgcaaacaugguuagaaucaagagaauauacaaaacaucugauaagaguggaaaauuggauauuccgaaauccaggcuucgcauuagcagcugcggcaauugcaugguuacugggaucaucuacaagucaaaaaguaauuuacuuaguuaugauacuauuaauagcaccagcauacucaauaagguguauaggaguaagcaauagagauuucguagaaggaaugucuggcgguacguggguggacguaguacuggaacacggaggauguguuacaguaauggcacaagacaaaccgacuguugauauugaauuaguuacaacuacaguuucaaauauggcagaaguaagaucauauugcuaugaagcaucaauaucugauauggcuucagauucaagaugucccacucaaggagaagcauaucuugauaaacaaucagacacccaauacguaugcaaacgaacauuaguagauagaggauggggaaacggaugcggacuuuuuggaaaaggaagucuagucacaugugcaaaauucgcaugcaguaaaaaaaugacugguaaaucaauucaaccagaaaauuuagaauacagaauaaugcucaguguacauggaagccaacauucaggaaugauaguaaaugauacaggacacgaaacagacgaaaauagagcuaaaguugaaauaacgccaaacucacccagggcggaagcaacucuaggugguuuuggaucucuaggauuagauugcgaaccuagaacaggauuagauuucucagacuuauauuacuuaacaaugaauaauaaacauugguuaguucauaaagaaugguuucacgacauuccuuuaccauggcaugcuggagcugauacaggaacaccacauuggaauaauaaagaggcauuaguggaauucaaagacgcacaugcgaaaagacaaacaguuguaguauugggaagucaagaaggagccguccauacagcacuagcgggggccuuagaagcggaaauggauggagcaaaagguagauuaucaaguggacaucuaaaaugucgauuaaaaauggauaaauuaagguuaaaaggagucaguuacagucuauguacagcugcauucacauucacaaaaauaccagcagaaacauuacauggaacaguuacugucgaaguucaauaugcaggaacugacggaccauguaaaguaccagcucaaauggccguagauaugcaaacacuaacaccaguaggaagacuaauaacagcaaacccaguaauaacagaaucuacggaaaauucaaaaaugauguuagaguuagauccaccauucggagacagcuacauaguaauaggaguaggagaaaaaaaaauaacucaucauuggcaucgaaguggaucaacauuaggaaaagcguuuucaacaacauuaaaaggagcucaaagacuagcagcacucggagacacugcaugggauuuuggaaguauaggagggguauuuaauagcaucggaagagcaguacaucaaguauucgguggagcuuucagaacuuuauuugguggaaugaguuggauuacacaaggacugaugggcgcacuacuauuauggaugggagugaaugcaagagauagaucaauagcauuggcauuccuagcaacugguggaguacucguauuuuuggcaacaaauguacacgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11728 - RNA, 2326 nt, Artificial Sequence
  ZIKV (strain ZikaSPH2015) ME variant mRNA Design 3 opt
gggagaaagcuuaccaugggaagaaaacaaaauaaaagaggugggaaugaaggaucaauaauguggcuagcuucacuagccguaguuauagcuugugcaggagcagugacaagaagaggaagugcauauuacauguacuuggacagaaacgaugcuggugaagccauaaguuuuccaaccacguuagguaugaauaaauguuacauucaaauaauggauuugggacauaugugugaugcuacaaugaguuaugaauguccaauguuagacgaagguguugaaccagacgauguagauugcuggugcaauacaacaaguacauggguuguauacgggacaugccaccacaagaaaggcgaagcaaggagaaguaggagagcggucacauuaccgagucauucuaccagaaaauuacaaacgagaagucaaacaugguuagaaagcagagaauauacaaaacauuuaauuagaguugaaaauuggauauuuagaaauccaggauucgcguuggcggcagcagcaauagcaugguuacucggaucaagcacaagucaaaaaguaauauaccuaguaaugauacuguuaauagcgccagcauauucaauacgauguauuggcgugagcaacagagacuuuguagaaggaaugucuggugguacauggguagauauagugcuagagcauggaggaugcgugacaguuauggcacaagauaaaccaacuguagacauagaauuaguaacaacuacaguuucaaauauggcagaaguuagaaguuauuguuaugaagcaucaauaagugacauggcaucagauuccaggugcccuacacaaggcgaagcauauuuagauaaacagucagauacacaauaugucuguaaaagaacgcuaguagauagaggauggggaaauggaugcggacuuuuugguaaaggaucauuaguaacaugcgcaaaauuugcauguucaaagaaaaugacaggaaaaucaauacaaccagaaaauuuagaauaccguauaauguuauccguacaugguagucaacauagugguaugauaguaaaugauacaggacacgaaacagaugaaaauagggcuaaaguugaaauaacaccgaacuccccacgagccgaagcuacauuaggaggauucgguagccuaggauuagauugugaaccgagaacagguuuagauuuuucagaucuauauuaucuuacaaugaacaacaaacauuggcuaguucacaaagaaugguuucaugacauaccacuuccauggcaugcaggagcagacacaggcacaccacauuggaauaauaaagaagcucuaguagaauuuaaagacgcucaugcaaagagacaaacaguuguaguccuaggaagucaagaaggugcaguucacacagcacuagcaggagcucuagaagcugaaauggauggagcgaaagguagacuaucaagcggacaccuuaaauguagguuaaaaauggauaaauuaagauugaagggaguaaguuauagcuuaugcaccgcugcauuuacauucaccaaaauaccggcagaaacuuuacauggcacgguuacaguagaaguccaauaugcaggaacggauggaccaugcaaaguacccgcacaaauggcaguagauaugcaaacauuaacuccuguaggccgacuuauaacggcaaauccuguuauaacagaaaguacugaaaauucaaaaaugauguuagaacuagacccuccauucggagauaguuauauaguaauuggaguaggagaaaagaaaauaacgcaucauuggcauagaagcggaucaacuauagguaaagcauuugaagcaacaguacgaggagcaaaaagaauggcaguacuaggagauacggcaugggauuuugguucaguaggaggagcauuaaauucauuaggaaaaggaauacaccaaauauuuggagcagcauuuaaaaguuuauucggaggaaugucaugguucagucaaauacuaauaggaacucuacuaauguggcuagguuuaaauaccaaaaaugguucaauaucauuaauguguuuagcuuuaggggguguauuaauauuucuaucuacagcuguauccgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11729 - RNA, 2326 nt, Artificial Sequence
  ZIKV (isolate Z1106033) ME variant mRNA Design 3 opt
gggagaaagcuuaccauggggagaaaacaaaauaaaagaggaggaaacgaaggaaguauuaugugguuagcuucauuagcagucguaauagcuugugcuggagcaguaacuagaagaggcucagccuacuauauguauuuggaccgaaaugaugcuggugaagcaaucucuuucccaacuacuuuagggaugaacaaauguuauauacaaauaauggaucuuggacauacaugugaugcgacaaugucauaugaauguccaaugcuagaugaaggaguggaaccugaugacguagauuguugguguaauacuacaucaacauggguagucuaugguacaugucaccauaagaaaggagaagcacgaaggucacgcagagcaguaacauuaccaucacacucaacaagaaaauuacagacaagaagccaaacauggcuagaaaguagagaauauacaaaacauuuaauaagaguagaaaacuggauuuuuagaaacccaggauuugcauuagcagcagcagcaauagcauggcuauuagguucaucaaccagucaaaaagugauauaucugguaaugauauuauuaauagcaccagcauauucaauaagaugcauuggaguaucaaauagagauuuuguugaaggcauguccggaggaacauggguagacguaguccuagaacauggagguugcguaacagucauggcucaagauaaaccuaccgucgacauagaauuaguaacuacaacaguaucaaauauggcugaaguacgaagcuauugcuacgaagcaaguauuucagauauggcaucagacaguagaugcccaacucaaggugaagcauauuuagacaaacaaagugauacacaauauguauguaaaagaacucucguagaucggggauggggaaauggaugcggacuuuuuggcaaaggcucacuugugacuugugcaaaauuugcguguaguaagaaaaugacaggaaaaucaauacaaccggaaaauuuagaauaucgaaucauguugucaguacacggaucacaacauagcggcaugauagucaaugauacgggacaugaaacugaugaaaauagagcuaaaguagaaauaacaccaaauucaccaagagcagaggcgacauuaggaggauuuggaucacuaggacuagauugugaaccaaggacaggauuagacuuuagugaccuauauuauuuaacuaugaacaauaaacauuggcuaguacauaaagaaugguuccacgauauaccuuuaccauggcaugcaggagcagauacgggaacaccccauuggaauaauaaagaagcacucguagaguucaaagaugcacacgcaaaaagacaaacaguaguaguauuaggaagucaagaaggugcaguacauacugcauuagcaggagcauuggaagcagaaauggacggagcaaaaggucguuugucaucaggacauuuaaaguguagauuaaaaauggauaaauuaagacuuaaaggagucaguuauucguuauguacagcugcauuuacauucacaaaaauaccagcugaaacacugcacggaacaguaacgguagaaguacaauacgcaggaacggacggaccguguaaaguuccugcacagauggcaguagauaugcagacacuuacuccaguagguagguuaauaacugcaaauccagucaucacagaaucuacagaaaauaguaaaaugauguuagaauuagaucccccauuuggagauucauauauaguaauagggguuggcgaaaagaaaauaacacaucauuggcauagaucaggaucaaccauaggaaaagcauuugaagcaacaguaagaggugcaaaaagaauggcagugcuaggcgacacagcaugggauuuuggaucaguaggaggagcacuaaacagccuaggaaaagguauacaucaaauauuuggagcugccuuuaaaaguuuauucggaggaaugucuugguuuagucaaaucuugauaggaacucuauuaaugugguuaggauugaaugcgaaaaauggaucaauuucacuaauguguuuagcauuaggagggguuuuaauauuuuuaaguacagcagugagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11730 - RNA, 2314 nt, Artificial Sequence
  ZIKV (strain MR 766) ME variant mRNA Design 3 opt
gggagaaagcuuaccaugggacgaaaacaaaacaaaagaggagggaaugaaggcucgauaaugugguuagcaucuuuagcaguagucauugcaugugcuggagcaauuacaagaagagguucagcuuauuacauguaccucgauagaagcgacgcagggaaagcaauuucauucgcgacaacauuaggaguaaauaaaugucauguucaaaucauggacuuaggucacaugugcgacgcaacaaugagcuacgaauguccaauguuggacgaaggcguggaaccagaugauguagauuguugguguaauacuacaucaacaugggugguauauggcacuugccaucauaagaaaggagaagcaaggagaucaaggagagcgguaacccuaccaagucauaguacuagaaaauuacaaacuagaagccaaacauggcuugaaaguagagaauacacaaaacauuuaauaaaaguugaaaauuggauauuuagaaauccaggauuugcauuaguagcaguagcaauugcuugguuauuagguagcagcacaagccaaaaaguaauauaccuaguaaugauauuauuaauagcaccagcguacaguaucagauguauaggaguaagcaauagggacuuuguagaaggaaugucaggaggaacguggguagauguaguacuagaacaugguggauguguaacaguaauggcacaagauaaaccaacaguagacauagaacuuguuacaacuacaguaaguaacauggcagaaguaagaagcuacuguuacgaagcgucuauaucagauauggcaucagauucaagauguccaacacaaggagaagcauacuuagauaaacaaucggacacucaauauguaugcaaaagaacccuaguagauagaggauggggaaauggaugcgggcuauucggaaaaggaucauuaguuacaugugcaaaauuuacauguaguaagaaaaugacaggaaaaucaauacaaccagaaaacuuagaauauagaauaauguuaaguguucauggaucacaacauuccgggaugauuggcuaugagacagaugaagacagggcaaagguagaaguuacaccaaauucaccccgagcagaagcuacuuuaggaggauuugguagccugggauuagacugugaaccuagaacgggauuggauuuuagugauuuauauuaucuaacaaugaauaauaaacauugguuaguccauaaagaaugguuucacgacauaccauuaccauggcacgcaggggcugacacaggaaccccacauuggaauaauaaagaagcauuaguugaauuuaaagacgcgcaugcaaaaagacaaacaguaguaguguuaggaagccaagaaggagcagugcauaccgcucuagcgggagcacuagaagcagaaauggauggagcaaaaggaagguuauuuucaggacaucuaaaauguagacuaaaaauggauaagcuaaggcuuaaggggguaaguuauaguuuauguacagcagcuuucacauuuaccaaaguaccagcggaaacguuacauggaacgguaacaguagaaguacaauaugcaggaacagauggcccguguaaaauaccgguucaaauggcaguagacaugcaaacauugacacccguugguagauuaauaacagcaaauccaguaauaaccgaaucuacagaaaacucaaagaugaugcuugagcuagauccaccauuuggagacagcuauauuguaauagguguaggggauaagaaaauuacacaucauuggcaucgaaguggaucgacuauagguaaagcauuugaagcuacaguaagaggugcaaaaagaauggcaguuuuaggagauacagcaugggacuuuggaaguguuggggguguuuuuaauucacuagguaaagggauacaucaaauauuuggagcugcauucaaaucauuauuugguggaaugucaugguuuucacagauacugauaggaacacuauuaguaugguuaggguuaaauaccaaaaaugguucaauaaguuugacaugucuagcauugggaggagucaugauauuucuuaguacagcuguaagcgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11731 - RNA, 2326 nt, Artificial Sequence
  ZIKV (strain NatalRGN) ME variant mRNA Design 3 opt
gggagaaagcuuaccaugggcaggaaacaaaauaaaagaggaggcaaugaaggaaguauuaugugguuagcaucauuagcggucguuauagcaugugcaggcgcaguaacaagacguggaagugcauauuacauguauuuggacagaaaugaugcaggagaagcaauaagcuuccccacaacgcuaggaaugaauaaauguuauauacaaauaauggauuuaggacacaugugugacgcaacaaugucuuaugaauguccaauguuggaugaaggaguagaaccagaugauguagauugcugguguaauacuacaaguacauggguaguuuauggaacaugccaucauaaaaaaggcgaagcaagacgaagcagaagagcggucacacuaccuucacauucaacccgaaaauuacagacaagaagccagacauggcuugaaucaagggaauauacaaaacacuuaaucagaguggaaaacuggauauuuagaaauccaggauuugccuuggccgcagcagcaaucgcauggcuacuuggaucaaguacuagucaaaaagucauauaucucguaaugauacuuuuaauagcaccagcuuauaguauaagauguauaggagucucaaauagagacuuuguagaaggaaugucaggaggaacauggguagacguaguauuagaacaugguggauguguaacaguaauggcucaagacaaaccaacaguagauaucgaauuaguaacuacaacugugagcaacauggcagaaguuagaucauauugcuaugaagcaucuauaucugacauggcuucagauucccgauguccaacacaaggagaggcuuauuuagauaaacaaucugacacacaauauguauguaaaaggacuuuaguagauagaggauggggaaaugguugcgggcuauuuggaaaaggcucguuaguaacaugugccaaauucgccugcaguaaaaaaaugacaggaaaaucaauacaaccugaaaauuuagaauauagaauaauguugucaguacauggaucucaacauucggggaugauaguaaacgauacaggacacgaaacagacgaaaauagagcaaaaguugagauaacaccaaauucaccucgagcagaagcaacacuggggggguuuggaagucucggauuggacugugaaccaagaaccggacuagauuuuucagauuuauauuauuugacaaugaacaauaaacacugguuaguacauaaagaaugguuccaugauauaccacuacccuggcaugcaggagcagauacagguaccccacacuggaauaauaaagaagcacuaguagaauuuaaagaugcacacgcaaaaagacaaacaguaguaguauuaggcucacaagaaggagcaguccacacugcacucgcaggugcgcuagaagcugaaauggauggagcaaaaggcagauuaagcaguggacacuuaaaauguagacucaaaauggauaaauuaagacuaaaaggcguaaguuauagucuauguacagcagcauucacauucacaaaaaucccagcagaaacacuacauggaacagucacaguagaaguacaauaugcuggaacagauggaccauguaaaguuccagcacaaauggcaguugacaugcagacacuaacaccaguaggacgacuaaucacagcaaauccagucauaacugagucaacagaaaauaguaaaaugauguuagaauuagauccuccauuuggugauucauauauaguaauuggaguuggagaaaaaaaaauaacgcaucauuggcacagaaguggaucgacaauaggaaaagccuuugaagcaacgguaagaggggcuaagaggauggcugugcuaggagauaccgccugggauuucgguuccguaggaggagcacuuaacagcuuagguaaaggaauucaucaaauuuuuggugcugccuucaaaucauuguuuggaggaaugucaugguucucacagauauuaauagguacguuguuaauguggcuuggauuaaacacaaaaaaugguucuauaagcuuaaugugcuuagcauuaggaggaguauuaauauuucucucaacagccguuagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11732 - RNA, 2299 nt, Artificial Sequence
  ZIKV (strain ZikaSPH2015) ME variant mRNA Design 3 opt
gggagaaagcuuaccaugaaugaagguucaauaaugugguuagcaucauuagcaguugugauagcaugcgcaggcgcagucacaaggagaggcucugcuuauuacauguauuuagaucgaaaugaugcaggggaggcaauaaguuuuccaaccacacuuggaaugaacaaauguuauauacaaauaauggauuuaggacauaugugcgaugcaacuaugucauacgaauguccaauguuagaugaaggagucgaaccagaugacguggauugcugguguaauacaacgagcacguggguaguauauggaacuugucaccauaaaaaaggagaagcuagacgaagcagaagagcaguaacauuaccaagucauagcacacguaaacuccaaacacgaucacaaaccugguuagagagcagagaauauacuaaacacuuaauaaggguagaaaauuggauuuuuagaaauccuggauucgcauuagcggccgcugcaauagcaugguuauugggaaguucgacaagccaaaaagucauauauuuaguaaugauuuuauuaauagccccagcauauucaauaagauguauaggcguaucaaauagagauuuuguagaagggaugaguggaggaacauggguagauauaguucuagaacauggaggaugcguaacagucauggcucaagauaaaccuacaguugacauagaacuaguaacaacaacaguaucaaauauggcagaaguaagaagcuacuguuaugaagcuucaaucucggacauggcaucagauucaagauguccaacgcaaggagaagcuuauuuggacaaacaaagcgacacccaauaugucuguaaaagaacauuaguggauaggggaugggguaauggauguggccuauuuggaaaaggaagccuaguaacaugugcaaaauuugcaugcaguaaaaaaaugacuggaaaaucaauucaaccagaaaaccucgaauauaggauaauguuaaguguacauggaagucaacacaguggaaugauaguuaaugauacaggccaugaaacagacgaaaacagagccaaaguagaaauaacuccaaauucaccacgagcggaagcgacacuaggaggauuugggucauuaggauuagauugcgaaccaaggacaggauuagauuucagugauuuauauuauuuaacaaugaacaauaaacauugguuaguacacaaagaaugguuucacgacauaccccucccauggcaugcaggagccgauacagggacuccucauuggaacaauaaagaagcguuaguagaauuuaaagaugcucacgcuaaaagacaaacaguuguaguacuaggaucgcaggaaggagcagugcauacagcauuagcaggugcacuagaagcagaaauggauggcgcaaaaggaagacuaaguucaggacauuuaaaauguagauuaaaaauggauaaauuaagauuaaaaggaguuucuuauagucuaugcacugcagcuuuuacauuuacaaaaauaccggcagaaacgcuacaugggacaguuaccguagaaguucaauacgcaggaaccgacggcccaugcaaaguaccagcacaaauggcuguugauaugcaaacauuaacaccgguuggaagacucauaacagcuaauccaguaauaacagaaucaacagaaaacucaaaaaugauguuagaauuagauccuccauucggagacaguuacauaguaauaggugugggagaaaaaaaaauaacccaucauuggcacagaaguggaaguacaauaggaaaagcauucgaagcuacuguacgaggcgcgaaaaggauggcgguauuaggagauacagcaugggacuuuggaucgguaggaggagcauuaaauucauuagguaaaggaauacaucaaauauuuggagcugcauuuaaaaguuuauuugguggaaugagcugguuuagucaaauauuaauaggaacauuauuaaugugguuagggcuaaauaccaaaaauggaucaauaagucuaaugugucuagcauuagguggugugcuuauauuuuuaaguacagcagucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11733 - RNA, 2299 nt, Artificial Sequence
  ZIKV (isolate Z1106033) ME variant mRNA Design 3 opt
gggagaaagcuuaccaugaacgaaggaagcauaaugugguuggcaucauuagcaguagucauagcaugugcaggagcgguaacaagaaggggaagugcuuauuauauguauuuagauagaaaugaugcaggagaagcaauaucauuuccuacaacacuaggcaugaacaaaugcuauauacaaauaauggauuuaggacauacaugugaugcaaccaugagcuacgaaugucccauguuagacgaaggaguagaaccagaugauguagauugcugguguaacacuaccucaacauggguaguauacggaacaugucaucauaagaaaggagaagcaagaaggagccguagagcaguaacauuaccaagucauagcacaagaaaacuacaaacacguagccagacauggcuggaaucuagagaauauacaaaacauuuaauaagaguugaaaauuggauauuuagaaauccuggauuugcauuggcugcggcugcaauagccugguuacuaggaucaucaacaucucaaaaaguuaucuauuuaguaaugauacuacuaauagcaccagcuuauucaauacgaugcauaggaguuucaaacagagacuucguugaaggcauguccgguggcacauggguagauguaguacuagaacacggaggaugcguaacaguaauggcacaagauaaaccaacuguagauaucgaauugguaacaaccacagugucaaauauggcugagguaagaagcuacuguuaugaagcaucaauuucagauauggcaagugacucacguuguccgacacaaggugaagcauaucuagauaaacaaucagauacacaauauguuuguaaacgaacauuaguagaccgagguuggggaaaugguugcggacuauuuggaaaagguucacuggucacaugcgcgaaauuugcaugcucaaagaaaaugacaggaaaaaguauacaaccugaaaaucuggaauauagaauuauguuaucaguucauggcucucaacacucaggaaugauaguaaacgauacuggucaugaaacugaugaaaauagagcuaaaguugaaauaacaccaaacaguccgcgagcggaagcaacauuaggcggauuuggaagucuuggacuagacugugaaccgagaacaggauuagacuuuagugauuuauacuaucuaacaaugaacaauaaacauugguuaguacacaaagaaugguuucacgauaucccuuuaccauggcacgcaggagcugacacaggaacgccucauuggaauaacaaagaagcauuaguagaauuuaaagacgcgcaugcaaaacgacaaacaguaguaguacuagggucacaagaaggagcaguacauacugcauuagcaggagcauuagaagcagaaauggacggagccaaagguagauuaagcagcggacaucuaaaaugcagacuaaagauggauaaauuaaggcuaaaaggaguaucuuacagccuguguacagcugcauucacauuuacuaaaauuccagcagaaacauuacauggaacaguuaccguagaagugcaauaugcaggaacagauggcccauguaaaguaccagcucaaauggcuguugauaugcaaaccuuaacgcccguuggacgacuaauaacugcaaaucccguaauaacagaaaguacagaaaacuccaaaaugaugcuugaauuagauccaccauuuggagauucuuauauuguaauagguguaggugaaaagaaaauuacacaucacuggcacagaaguggaucaacaauaggaaaagcauuugaagcaacaguccgaggugcaaaaagaauggcaguacuaggagauaccgcuugggauuuugguucaguagguggagccuuaaacaguuuaggaaaaggaauacaccaaauauuuggagcagcauuuaaaucauuauucggaggaaugaguugguuuagccaaauauugauugguacgcuguuaauguggcuaggacuaaaugcaaagaauggaaguauaucauuaaugugcuuagcccuuggaggaguauuaauuuuucucaguacagcagucucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11734 - RNA, 2287 nt, Artificial Sequence
  ZIKV (strain MR 766) ME variant mRNA Design 3 opt
gggagaaagcuuaccaugaaugaagguagcauaaugugguuagcaaguuuagcaguaguaauugcuugcgccggagcaaucacgagacgaggaucagcauacuauauguacuuagauagaagcgaugcaggaaaagcuauaagcuuugcuacaacauuaggaguaaauaagugucaugugcaaauaauggacuugggacauaugugugaugcaaccaugucuuaugaauguccaauguuagaugaaggaguagaaccugacgauguagauugcugguguaauacaacaucaacauggguuguauacggaacgugccaccauaaaaaaggagaagcaaggagaucaagaagagccguaacacuaccaagucacucaacacgaaaacuacaaacaagaagucaaacaugguuagaaagcagagaauauacaaaacauuuaauaaaaguagaaaauuggauauucaggaauccagguuuugcuuuaguugcaguagcuauagcuuggcuauuaggaagcagcacgucacaaaaaguuauuuaucuaguaaugauacuacugauagcaccagcguacucaauaagaugcauuggaguuucaaauagagauuuuguagaaggaaugagcggaggaacuuggguagacguaguucuagaacaugggggaugcguaacaguuauggcacaagacaaaccaacaguagauaucgaacuaguaacaacuacaguaucaaauauggcagaaguacgaaguuauugcuacgaagcaucaaucucggauauggcaagugauagucguuguccgacacaaggcgaagcauacuuagauaaacaaagugauacgcaauaugucuguaaaagaacauuaguagacagaggguggggaaauggaugcggacuauuugguaaaggauccuuaguaacaugcgcuaaauucacuugcucuaaaaaaaugacagggaaaaguauacaaccugaaaaccuggaauaucgaauaauguuaucaguucauggaucacaacauucaggaaugauaggauacgaaacggaugaagauagagcaaaaguagaaguaaccccaaauaguccuagagcugaagcuacacuaggagguuuuggcucacuaggauuagauugugagcccagaacaggacucgauuucagugaucuauauuauuuaacaaugaauaauaagcauuggcuaguacacaaagaaugguuucaugacauaccucugccauggcaugcaggagcagauacaggaacaccccacuggaauaauaaagaagcuuuagucgaauucaaagacgcucacgcaaaaagacagacaguugucguuuuaggaagucaagaaggagcaguacauacagcucuagcuggugcauuagaagcagaaauggauggugcaaaaggaagauuauuuagcggacaucuaaaaugucgauuaaaaauggauaaauuaagauuaaaagggguaucauauagucuauguacagcagcauucacauuuacgaaaguaccggcagagacauuacauggaacaguaacaguugagguccaauacgcaggaacagacggacccuguaaaauaccugugcaaauggccguagacaugcaaacguuaacuccaguaggaagacuaaucaccgcaaauccaguaauaacugaaucaacugaaaauaguaaaaugaugcuugaauuagauccaccauucggagauucauauauaguaauuggaguuggugauaaaaaaaucacacaucauuggcauagaucagggucaacaauaggaaaagcauucgaggcgacaguaagaggagcuaaaagaauggcuguucuaggagauacagcaugggauuucggcagcguaggcgguguauucaacagcuuaggaaaagggauacaucaaauauuuggcgcagcauuuaaaagucuauuuggugguaugucgugguuuucacaaauacuaauaggaacccuauuaguuugguuaggacuaaauacaaaaaacggaucaauaucucuaacaugcuuagcauuaggaggagugaugauuuuucuaagcacagcaguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11735 - RNA, 2299 nt, Artificial Sequence
  ZIKV (strain NatalRGN) ME variant mRNA Design 3 opt
gggagaaagcuuaccaugaacgaaggaaguauaaugugguuagcaaguuuagcagucguaauagcaugugcgggagcaguaacuagaaggggaagugcauauuauauguaccuagauaggaaugacgcuggugaagcaauaucauuuccaacuacuuuagggaugaauaaaugcuauauacaaauaauggauuuaggucauaugugugaugcaacaaugaguuaugaauguccaauguuggacgaaggaguagaaccagaugacgucgauuguugguguaauacaacaagcacauggguaguuuacggaacgugucaccacaagaaaggagaggcaagacgaaguagacgagcagucacauuaccaagccacaguacaagaaaacuucaaacuagaagucaaaccuggcuagaaucaagagaguacacaaaacaccuaauaagaguagaaaauuggauauuuagaaauccaggauuugcucuagcagcagcagcaauagcaugguuacuaggaagcaguacaagucaaaaaguuauauaucuaguaaugaucuuauuaauagcucccgcguacucgauaagauguauuggagugaguaauagagauuuuguagaaggcaugucaggcgguaccuggguagauguagugcuagaacauggaggaugcguaacaguaauggcacaagauaagccaacaguagauauagagcuaguaacgacaacaguuucuaauauggcagaaguuagaaguuauugcuaugaagcuaguauaucagacauggcaagcgacaguagaugcccaacacaaggagaagcauauuuagauaaacaaagugauacacaauaugucugcaaacgaacucuaguagacagaggguggggaaaugguuguggauuauucgggaaaggaucauuaguuacaugcgcuaaauuugcauguagcaagaaaaugacaggcaaaaguauacaaccagaaaauuuagaauauagaauaauguuaucaguacacgggucgcaacauaguggaaugauuguuaaugacacaggccaugaaacagaugaaaacagggcgaaagucgaaauaacaccaaacuccccaagggcagaagcaacauuaggaggauuuggaagucuaggucuagacugugaaccaagaacugguuuagauuuuagugaucuauauuacuuaacuaugaauaacaaacauuggcuagugcauaaagaaugguuucaugauauacccuuaccauggcaugcaggagcagauacaggcacaccucauuggaauaauaaagaagcauugguagaauuuaaagaugcacacgcaaaacgccaaacaguaguaguacuaggaucacaagaaggugccguacauacagcacuagcuggugcacuugaagcagagauggauggcgcuaaaggacgauuaucaucaggacaccuaaaaugucgacugaaaauggauaaacuaagacuaaaagggguaaguuauucacuauguacagcagcauuuaccuuuaccaaaauaccagcugaaacauuacauggaacuguaacuguagagguacaauaugccgguacugauggaccauguaaaguaccagcacaaauggcaguagauaugcaaacauuaacgccaguaggaagauugauaacagcgaauccaguaauaacagaauccacagaaaacucaaaaaugaugcuagaauuagauccaccuuuuggagauucuuauauaguaaucggaguuggagaaaagaaaauaacucaucauuggcacagaucaggaaguacaauagguaaagcauuugaagccaccguaagaggagcuaaaagaauggcaguauuaggagauacagcaugggauuuugguaguguaggaggugcacuaaauucacuagguaaagggauacaucaaauauuuggggcagccuuuaaaucauuauuuggaggaaugaguugguuuucucaaauauuaauaggaacuuuauuaaugugguuaggacucaacacuaaaaacggaagcauaaguuuaauguguuuagcacuuggaggaguacuaauuuuucuaagcacagcaguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11736 - RNA, 2326 nt, Artificial Sequence
  ZIKV (strain ZikaSPH2015) prME-short variant mRNA Design 3 opt
gggagaaagcuuaccaugggacggaaacaaaacaaaagaggaggcaacgaaggcucaauaauguggcucgcaagccuagcaguaguaaucgcaugcgccggggcgguaacacgacgcggcucagcauacuacauguaccuggaccgcaacgacgccggcgaagcuauauccuuccccaccacgcucggaaugaacaaaugcuacauacaaauaauggaccuuggccacaugugcgacgcaacaauguccuacgaaugccccaugcuggacgaaggaguagaaccggacgacguagauugcuggugcaacaccacgaguaccugggucguauacggcacaugccaccacaaaaagggcgaagcacgccgaagccgacgagccgucacccugcccagccacagcacccgcaaacuccagacccgcagccaaaccuggcuggaaagccgagaauacaccaaacacuuaaucagagucgaaaacuggaucuucagaaaccccggauucgcucucgcagccgccgcaauagcauggcugcucggcucguccacaucacaaaaagucaucuaccuaguaaugauccuccugaucgccccagccuacagcauccgcugcauaggaguaagcaaccgugacuucguggaaggaaugucaggaggcaccuggguagacauaguccucgaacacggaggcugcgucacaguaauggcacaagacaaaccaaccgucgacaucgaacucguaaccacaaccguauccaacauggcggaggucagauccuacugcuacgaagccagcaucagcgacauggccuccgacuccagguguccaacccagggagaagcauaccucgacaaacaaucugacacccaauacgucugcaaacgaacccuagucgaccgaggguggggcaacggcugcggacuguucgggaaaggaagucuaguuacaugcgcaaaauucgccugcagcaaaaagaugacaggaaaaucaauacagccagagaaucucgaguacagaauaaugcucuccguccacggcucacaacacucaggcaugauaguaaacgacacgggacacgaaacagacgaaaacagagcaaaggucgagaucacacccaacagcccacgugcggaagcaacacugggaggcuuuggcagccuaggacuggacugcgaaccccgcaccggccucgacuucagcgaucucuacuaccucacgaugaacaacaagcacuggcugguccacaaggaaugguuucaugacauaccacuaccauggcacgcaggcgccgacacagggacaccccacuggaacaacaaagaagcacuggucgaguucaaagacgcgcacgccaaaagacaaaccguaguaguccuaggcucccaagaaggagcaguccacacggcacuagccggcgcgcucgaagcggaaauggacggagccaaaggaagacuaaguucaggacaccuaaaaugcagacuaaaaauggacaaguuacgacugaaaggagucucguacagccucugcacggcagccuucacauucaccaagauaccagcagaaacccuacacggcaccguaacggucgagguacaauacgccggaaccgacggaccaugcaaagucccagcacaaauggcagucgacaugcaaacccuaacacccgucggccggcuuaucacagcaaacccgguaaucacagaaaguacagagaacuccaaaaugaugcucgaacucgacccgcccuucggagacagcuacaucgucaucggcgucggcgagaagaaaaucacacaccacuggcaccggagcggaucaacgaucggcaaagcauucgaagccacaguaagaggugcaaaacgaauggccguccuaggggauacagcaugggacuucggcagcguaggcggcgcacugaacagccuugggaaaggcauacaccaaaucuucggagcagcauucaaaagccuguucggaggcaugagcugguucucucaaauccuaauaggaacccuccucauguggcucggccuaaacaccaaaaauggaagcaucagccucaugugccuagcacuaggaggcguccuaaucuuccugaguacagccguaagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11737 - RNA, 2326 nt, Artificial Sequence
  ZIKV (isolate Z1106033) prME-short variant mRNA Design 3 opt
gggagaaagcuuaccaugggccgaaaacaaaacaaacgcggaggcaacgaaggauccauaauguggcuagcuucccuggccguuguaauagcgugcgcuggcgccgucacacgacgaggauccgccuauuacauguaccucgaccgcaacgacgccggagaagcaauaucauucccgacaacccuugggaugaacaaaugcuacauacagaucauggaccucggacauaccugcgacgcaaccauguccuacgaaugcccaaugcuagacgagggagucgagccagacgacguggacugcuggugcaacaccacaagcacaugggugguauacggaaccugccaccacaagaaaggcgaagcccgucgaagcaggcgagcagugaccuuaccaagccacagcaccagaaaacuccagacacgcucacaaacauggcucgaaagcagggaauacacgaaacaccuaaucaggguagaaaacuggaucuuccgaaacccaggcuucgcccucgccgccgcagcaaucgcauggcuacuaggcucgagcacaagccaaaaagucaucuaucucgucaugauacuccuaauagcacccgcauacucaauacgaugcauaggugucagcaaccgcgacuucgucgaaggaaugagcggaggaaccuggguagacguaguccucgaacacggcggauguguaacagucauggcccaagacaaaccuacagucgacauagagcuaguaaccacgaccguaagcaacauggcagaaguacgaagcuacugcuacgaagccucgaucagcgacauggcaagcgacucccgcugcccaacccagggagaagcauaccuggacaaacaaagcgacacacaauacgucugcaaacggacacucgucgaccgcggauggggaaacggcugcggacuauucggcaaaggcagccuaguaacaugugcaaaauucgccuguuccaagaaaaugaccgggaaaucaauacaaccggaaaaccuagaauaccgaauaaugcucagcgugcacggaucacaacacucugggaugauaguaaaugacaccggccacgaaacugacgaaaaccgcgccaaaguagagaucacccccaacucgccccgcgcagaagccacacuaggcggcuucggaucccugggccucgacugcgaaccacgaacgggacuagacuucucagaucucuacuaccucaccaugaacaacaaacacuggcuaguccacaaagaaugguuccacgacaucccacuccccuggcacgccggagcagauaccggaaccccgcacuggaacaacaaagaagcgcuagucgaguucaaagacgcacacgcaaaaagacaaacggucgugguacuaggcucccaagaaggcgcaguccacaccgcucuggccggugcacuggaagcggaaauggauggcgcuaaaggccgccucucaagcggccaccucaaaugccgacuaaaaauggacaaacuacgccucaaaggggucagcuacagccuaugcacagcagccuucaccuuuaccaaaauaccagcagaaacccuacacgguacaguaaccguugaagugcaauaugcaggaacagacggacccugcaaagucccggcacaaauggcagucgacaugcagacccugacaccaguaggccgacuuaucacagccaacccagucaucaccgagucaacagaaaacuccaaaaugaugcucgagcuagacccaccauucggagauagcuacaucguaaucgggguaggggaaaagaagauaacacaccauuggcacagaagcggcagcacuauaggaaaagcauucgaagccacagugaggggagcaaaacgcauggccgugcucggcgacacagcaugggacuucggcuccguaggcggcgcccugaacagccugggaaaaggaauacaccaaauauucggagcggcauucaagucccuauucggcggcaugucaugguucucacaaauacugaucggcacacugcuaauguggcuaggccucaaugcuaagaacggcagcauaagccucaugugccuagcgcucgggggaguacuaaucuuucuaaguaccgccgugagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11738 - RNA, 2314 nt, Artificial Sequence
  ZIKV (strain MR 766) prME-short variant mRNA Design 3 opt
gggagaaagcuuaccaugggccguaaacaaaacaaacgaggaggcaacgaaggaagcauaauguggcuagccucccucgcaguaguaauagccugcgccggcgcaaucacccgccgaggcucggccuacuacauguaccuagacaggagugacgcaggcaaagccaucagcuucgcaacaacccucgggguaaacaaaugccacguacaaaucauggaccucggacacaugugcgacgccacgaugucauacgaaugccccaugcuagacgaaggagucgaacccgacgacguagacugcuggugcaacacaaccagcacgugggugguauacggaacaugccaccacaagaaaggagaagcacgaaggagcagaagggcagugacccuaccgagccacuccacccgcaaacuccaaacacggagccaaacauggcucgaaagccgagaauacacaaaacaccucauaaagguagaaaacuggaucuuccgcaacccaggcuucgcccuagucgccguagcaauagccuggcuacuagguuccagcacaucccagaaggucauauaccuggucaugauauuacuaauagcgccggcauacagcauucgaugcauaggcguaagcaaccgagacuucguagaaggcauguccggcggaaccugggucgacgucguacucgagcacggagggugcguaaccgugauggcccaagauaagcccacagucgacauagaacucguaaccaccacggucaguaacauggcagaagugagauccuacugcuacgaagcguccauaagcgacauggccucagacagccgauguccaacccaaggggaagccuaccuggacaaacaaucagacacucaauacgucuguaagagaacccuagucgacagaggauggggcaacggaugcggacuauucggcaaaggcucacucgucacaugcgcaaaauucacaugcuccaagaagaugacaggaaaaagcauacaaccagaaaaccucgaguacagaauaaugcucuccgugcacggcucacaacacagcggaaugaucggcuacgaaacugacgaagaccgcgcaaaaguggaggugacacccaacucaccccgcgcagaagccacccucggcggauucggcagccucggccuagauugcgagccacgaacaggccuagacuucagugaccuauacuaccuaacaaugaacaacaaacacugguuagugcacaaagaaugguuccacgauaucccacuacccuggcacgcaggcgccgacacagggaccccacacuggaacaacaaagaggcccucguagaguucaaagacgcacacgccaaacgacagacaguaguaguacugggaucucaggaaggcgcggugcacaccgcacuagcgggcgcccuggaagccgaaauggacggagcaaaaggacgccucuucuccggacaccugaaaugcagacucaaaauggacaaacugcgccucaaaggcgucagcuacagccugugcaccgcagcauuuaccuucacaaaagucccugcagaaacacuccacggaacagugacaguagaaguacaauacgccggcacagauggcccaugcaaaauacccguccagauggccgucgacaugcaaacccuuaccccagucggacgccucaucacagcaaacccggucauaaccgaauccacagaaaacucgaaaaugaugcuggaacucgacccacccuucggcgacaguuacauaguaaucgguguaggagacaagaaaaucacacaccacuggcaccgcagcggcucaacuaucggcaaagcauucgaggccacagucagaggcgcaaaacgaauggcuguccuaggcgacacagccugggauuucggcagcguaggcggcgucuucaacucccucggcaaaggaauacaccaaauuuucggggccgcauucaaaucacucuucggaggaaugucaugguucucgcaaauccucauaggcacccuccuaguauggcucggacucaauaccaaaaacggaucaaucagccuaaccugucuugccuuaggaggaguaaugaucuuccucagcaccgcagucagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11739 - RNA, 2326 nt, Artificial Sequence
  ZIKV (strain NatalRGN) prME-short variant mRNA Design 3 opt
gggagaaagcuuaccaugggccgaaagcaaaacaaacgcggcggcaacgaaggaucaaucauguggcucgccucccucgcaguaguuaucgccugcgccggcgccgucacgcgacgcggcucagcauacuacauguaccuggaccgaaacgacgcaggcgaagccauauccuuccccaccacccucggaaugaacaagugcuacauucaaaucauggaccugggucacaugugugacgccacaauguccuacgaaugcccaaugcuggacgaaggcgucgaaccagacgacgucgacugcuggugcaacacuacaucaacauggguaguauacgggaccugccaccacaagaaaggcgaagcacgacgcuccagacgagcagucacacugcccucccacuccacccgaaaacuacagacacggucccaaacauggcucgaaagcagggaauauaccaaacaccuaauccgcgucgagaacuggauauuucgaaaccccggcuucgcacucgccgccgccgccaucgccuggcuccuaggauccagcacaucacaaaaagucauauaccucguaaugauacuacucauagcgcccgcauacagcauaagauguaucggcguaagcaaccgagacuucguagaaggcaugucaggaggcacaugggucgauguaguccuagaacacggaggcugcguaacagucauggcccaagacaaaccaaccgucgacauagagcuagugacaaccaccguaucaaacauggccgaaguaagaucauacugcuacgaagccuccaucuccgauauggcaagcgacucacguugccccacccaaggugaagccuacuuagacaaacaaagcgacacacaauacgucugcaaaaggacccucguagaucgcggauggggaaacggcugcggacuauucgguaaaggaucgcucgugacaugugccaaauucgccugcuccaagaaaaugacaggcaaauccauccaaccagaaaaccuagaauaccgcauaaugcucucaguacacggaucccaacacagcggcaugaucgucaacgacacaggccacgaaaccgacgagaacagagccaaaguagaaauaacacccaauagcccacgcgcagaagccacacucggcggauucggaucucucggccucgacugcgagccacggacaggacuugacuuuuccgaccucuacuaccugaccaugaacaacaaacacuggcuagugcacaaggaaugguuccaugacaucccucuccccuggcacgcaggagccgacacgggcacaccgcacuggaauaacaaagaagcccucguagaguucaaggacgcacacgccaaacgacaaacggucgucguccuaggaucacaagaaggcgcaguacacacagcgcucgccggagcccuagaggcggagauggacggggcaaaaggccgccucuccaguggacaccucaagugccgacucaaaauggauaagcuccgacucaaaggcguaucuuacucccuaugcaccgccgcauucacauucacgaaaauccccgccgaaacccuccacggcacggucaccgucgaaguacaauacgcaggcaccgauggcccaugcaaaguaccagcacaaauggcaguggacaugcaaacacucaccccagucggacgacucaucaccgcaaacccagucaucaccgaauccaccgaaaacucaaaaaugaugcuagaacucgacccacccuucggcgauaguuacaucgucauaggcgugggggaaaagaagauaacacaucacuggcaccgaucaggguccacgaucggcaaagccuucgaggccacaguacgcggagcaaagcgcauggcaguccuaggagauacagccugggauuucgggaguguaggcggcgcccuaaacagccuaggcaaaggcauacaccaaauauucggcgccgccuucaaaagccuauucggaggcaugagcugguucagccaaauacucauaggaacgcuccucauguggcuuggacuaaacacaaagaacggaagcauaagccucaugugccuagcacuaggaggcguacuaaucuuccugagcaccgcggucagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11740 - RNA, 2299 nt, Artificial Sequence
  ZIKV (strain ZikaSPH2015) prME-short variant mRNA Design 3 opt
gggagaaagcuuaccaugaacgaagggucaaucauguggcuugcaucccuagcaguagugaucgccugcgcgggcgcggucacacgacggggcuccgccuacuacauguaccucgaccgcaacgacgcaggcgaagcaaucagcuuccccacaacgcuaggaaugaacaaaugcuauauacaaauaauggaccucggccacaugugcgacgcaaccaugagcuacgaaugcccaaugcuagacgaaggcguggaaccggacgacguggacugcuggugcaacaccacauccacaugggugguauacgguaccugccaccacaagaaaggcgaagcacgaaggucacggagagcagucacccuaccaucccacagcaccagaaaacuacaaacacgaucccagaccuggcuagaaagccgcgaauacacgaagcaucuaauaagggucgaaaacuggauauuccgaaaccccggauucgcacuagccgcagcggcaauagcauggcuacuagggucaagcacgucccaaaaaguaauuuacuuaguaaugauccuccuaauagcaccagccuacucaaucagaugcauaggcguaagcaaccgagacuucguagaaggcaugagcggcgggaccuggguagacauaguacucgaacacggaggcugcguaaccguaauggcacaagacaaaccaacaguagacaucgagcuaguaaccacaacaguaucgaacauggcggaaguacgcuccuacugcuacgaagccucgaucuccgacauggccagcgacucacgcugcccgacccaaggggaagcauaccuagacaaacaauccgacacgcaguauguaugcaaacgaacacugguugaccguggaugggggaauggaugcggacucuucggaaaaggcucgcucgucacaugcgccaaauucgccugcagcaagaaaaugaccggcaaaagcauucaaccagaaaaccucgaauaccgaaucaugcucagcguacacggcucacaacauagcgggaugauagucaacgacacaggacacgaaacggacgaaaaucgggcaaaagucgaaaucaccccaaacucaccacgcgcagaagccacacucggaggcuucggcagccuaggacuagacugcgaacccagaacgggacuagacuucagcgaccucuacuacuuaaccaugaacaacaaacacuggcugguccacaaagaaugguuccacgacauaccacucccauggcacgcaggcgccgacaccgggaccccacauuggaacaacaaagaagccuuaguagaguucaaagacgcgcacgcaaaaagacagacagugguaguacugggaagccaagaaggcgcaguccacacagcacuagccggagcgcuggaagccgaaauggacggcgccaaaggcagacuauccuccggacaccucaaaugccgccucaaaauggacaaacuacgccuaaaaggagucagcuacucacucugcacagccgcguucaccuucacuaaaauacccgcagaaacccuacacgggaccgucaccguagaaguacaauacgccggcacugacggaccaugcaagguaccagcccaaauggccgucgacaugcaaacccuaacucccguaggacgacucaucacggccaaccccguaauaaccgaaagcacagagaacucaaaaaugaugcucgaacuagacccacccuucggagacagcuacaucgucaucggcguaggcgagaaaaagauuacccaccacuggcacaggagcggcagcacgaucggaaaagccuucgaagccacagucagaggggccaaacgcauggccguacugggcgacacagccugggacuucggcaguguaggaggggcccucaacagccucggaaaaggcauccaccaaauuuucggagccgcuuuuaaaagucuauucggaggaauguccugguucucacaaauacucauuggcacacuccuaauguggcucggccuaaacaccaagaacggcagcaucagccuaaugugccuagcccucggcgggguacuaauauuccugagcacagccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11741 - RNA, 2299 nt, Artificial Sequence
  ZIKV (isolate Z1106033) prME-short variant mRNA Design 3 opt
gggagaaagcuuaccaugaacgaaggcucgaucauguggcucgccucccuagcagucgucaucgcaugcgcaggagcagucacccgccggggauccgcguauuacauguaccucgaccggaacgaugcaggagaagcaaucagcuucccgaccacacucgggaugaacaaaugcuacauacaaauaauggaccucggacauaccugcgacgcaaccauguccuaugaaugcccgaugcuugacgaaggagucgaaccagacgacguagacugcuggugcaacaccacaagcacaugggugguauacggcacaugccaccacaagaaaggagaagcgcgcaggaguagacgcgccgucacccucccaagccacucaacacgcaaacuccaaacacgaucacaaaccuggcucgaaagccgagaauacaccaagcaccuaauccgcgucgagaacuggaucuuccgcaacccaggauucgcgcucgccgcagcagccaucgccuggcuccuaggguccagcaccagccaaaaggugaucuaccuagucaugauacuccucaucgcaccagcauacucgauccgcugcauaggcguaucaaauagagacuucguagagggaauguccggcggaaccugggucgacguaguccuagaacacggcggcugugucaccgugauggcacaagacaaaccaacaguagacauagaacuuguaacaacgacaguaaguaacauggcggaaguccgcagcuacugcuacgaagcauccauaucagacauggccagcgacagccgcugccccacgcaaggcgaggcauaccuagauaagcaaucagacacccaauaugucugcaaaagaacccuaguggaccgcggcuggggcaacggaugcggccucuucgggaaaggcucccucgucacgugcgccaaauucgccugcucaaagaaaaugaccggaaaaagcauacaacccgaaaaccuagaauaccgaaucaugcucucgguacacggaucacaacacagcggaaugaucguaaaugacaccggacaugagacagacgaaaacagggccaaagucgaaaucaccccaaauaguccccgcgcagaagccacccucgguggguucggcagucucggacuagacugugaaccacgaaccggccucgacuucagcgaccuauacuaccuaacaaugaacaacaaacacuggcucguccacaaagaaugguuccacgauaucccgcuacccuggcacgccggagccgacaccgggacaccacacuggaacaacaaagaagcccucgucgaguucaaagacgcgcacgcuaaacgccaaaccguagugguccucggaucccaggaaggagccguacacaccgcacuagcaggagcccucgaggccgaaauggacggcgcaaaaggaagacucucaagcggccaccucaagugcagacucaaaauggacaaacuaagacugaaaggaguauccuacucccucugcacggccgccuucacauucacuaaaaucccagccgaaacgcuccacggaacaguaacaguggaagugcaauacgcgggaacugacggaccaugcaaaguacccgcccaaauggccgucgacaugcaaacacuaacaccagucgggcgacuaaucacagccaauccaguaauaacggaaucaaccgaaaacaguaaaaugaugcuagaacuagacccacccuucggagacagcuauauaguaaucggagucggagaaaagaaaauaacccaccacuggcacagaagcgggagcaccaucgggaaagccuucgaggcaacggugagaggcgcaaaacgaauggccguccucggagacaccgcaugggacuucggauccgugggcggagcccugaacucacuaggaaaaggcauccaucaaauauucggggccgccuucaaaucccucuucggcgggaugucgugguucucacagauacucaucgggacacuacucauguggcucgggcucaacgccaaaaacggaagcaucucacucaugugccuagcacuagggggaguccuaaucuuccuguccacagcaguaagcgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11742 - RNA, 2287 nt, Artificial Sequence
  ZIKV (strain MR 766) prME-short variant mRNA Design 3 opt
gggagaaagcuuaccaugaacgagggcucaaucauguggcuggccucacuagccguagugauagcaugcgcaggcgcaaucacacgccgggguucagcauacuacauguacuuagacagaagugacgcaggaaaagcaaucucauucgccacaacccuaggagucaacaaaugccacguacaaauaauggaccuaggccacaugugcgacgcaacgauguccuacgaaugccccauguuggacgaaggcguagagcccgacgaugucgacugcuggugcaacaccacgaguaccuggguagucuacggcacgugccaucacaagaaaggagaagccagaaggucgaggagagcagucacacugccgagccacagcacacgaaaacuccagacacgaucccagaccuggcucgaaagcagggaguacacaaaacaccucauaaaagucgaaaacuggaucuucaggaacccaggauucgcgcuaguagcaguagccaucgccuggcugcuagguagcagcacgucccaaaaagucauauaccucguaaugauccuauuaauagcaccagcauacucgauaagaugcauaggaguaaguaaccgagacuucguagaaggaaugucaggcggcacauggguagacguaguacuagaacacgguggaugcguaaccgugauggcacaagacaaacccacaguagacauagagcuaguaaccacgacuguaagcaacauggcugaaguccgaagcuacugcuacgaggcaucgaucuccgacauggccuccgacagccgcugcccaacacaaggagaagccuaccuagauaaacaaucggacacgcaauacgucugcaaacgcacucuagucgaccgcggauggggaaacggcugcggacuguucggaaaaggcagccuaguaacaugcgccaaauuuaccugcucaaagaaaaugaccggcaaaucaauacagccagaaaaucucgaauacagaaucaugcuaucaguacacggcucgcaacacagcgggaugaucggguacgaaacagaugaagaccgagcaaaaguagaagucacaccgaacagcccaagagcagaagccacacuuggaggguucggaucacuaggcuuggacugcgagccacgcacaggucuagacuucagcgaccuguacuacuugaccaugaacaacaaacauuggcuaguacacaaagagugguuucacgacauaccccuccccuggcacgccggcgccgacaccggcaccccacauuggaacaacaaagaagcgcuggucgaauuuaaagacgcgcacgcaaaacgacagacggucguaguacucgggagucaagaaggcgccguccacacagcccucgcaggggcgcuagaagcagaaauggacggggcgaaagggaggcuauucaguggccaccuaaaaugccggcucaaaauggacaaacuacgauugaaaggagucucauacucacuaugcaccgcggcguucacauucacaaaagucccggccgagacacugcacggaaccguaaccgucgaaguacaguacgcaggaaccgauggccccugcaagaucccgguacaaauggcggucgacaugcaaacccucacccccguaggacgacuaauaaccgcaaaccccgucauaacagaauccacagaaaacagcaaaaugaugcuagaacucgacccgcccuucggugacuccuacaucguaaucggugucggcgacaagaaaaucacacaucacuggcaccgaagcggcagcacaaucggaaaagcauucgaagccacagugcgcggcgcaaaacgaauggcaguacugggcgacaccgcuugggacuucggcagcgucgggggcguauucaacagucuaggcaaaggcauucaccagaucuucggagcagcguucaagagccuauuuggaggcauguccugguucagccagauucuaauaggcacacuucuagucuggcuaggacuaaacaccaaaaacggaagcaucagccuaaccugccucgcgcucggaggcguaaugauauuccuaagcacugccguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11743 - RNA, 2299 nt, Artificial Sequence
  ZIKV (strain NatalRGN) prME-short variant mRNA Design 3 opt
gggagaaagcuuaccaugaacgagggaagcauaauguggcucgcaucauuagcagucguaaucgccugcgccggagccgugacgagacgcggcuccgccuauuacauguaccuagaucgaaacgacgcaggcgaagccauaucauucccaacgacacuaggaaugaacaagugcuacauacaaauaauggaccuaggccacaugugcgacgcaaccaugagcuacgaaugcccaaugcucgacgaaggcgucgaacccgacgacguagacugcuggugcaacacuacauccacauggguagucuacggaacgugccaccacaaaaagggcgaagcaagacgaagcagacgcgccgucacacucccaagucacagcacccgaaaacuccaaaccagaagccagacauggcuagaauccagggaguacaccaaacaccuaauaagagucgaaaacuggaucuuccggaacccaggauuugcccuagcugcggcggcgauagcauggcuacucggcucaucaacaagccagaaagucaucuaccucguaaugauccugcucauagcaccagcguacucaauaagaugcauaggcgucagcaacagggacuucguugaaggcaugucaggcggcaccuggguggacguaguccucgagcacggaggcugcgucacaguuauggcacaggacaaacccaccgucgacaucgaacucgucacaaccacagucagcaacauggccgaaguccgcagcuacuguuacgaggcaagcaucagcgacauggccucggacuccaggugcccaacacaaggagaggcauaucuggacaagcagagcgacacacaguacgucugcaaacgaacgcuaguggaccgcggauggggaaacggcugcggacuuuucggcaagggaagccuaguaacuugcgcaaaguuugccugcucaaagaaaaugaccggaaaaagcauccaaccggaaaaccuagaauacagaaucaugcugagcguccacggaucccaacacagugggaugauaguaaacgacacaggacacgaaacagacgaaaaccgagccaaagucgaaaucacacccaacagcccgcgagcagaagcaacacucgggggcuucggaucacuaggacuagacugcgaaccacgcacagggcuagacuucagugaccuguacuaccuaacgaugaacaacaagcacuggcucguucauaaagaaugguuccacgacaucccccuaccguggcacgcaggggcagacacaggaacaccccacuggaacaacaaagaagcccucguggaguucaaagacgcacacgccaaacggcaaaccguaguaguccuuggaagccaggaaggagccguccacaccgcgcucgccggcgcccuagaagccgaaauggacggcgcaaagggacgacucagcagcggacaccuaaagugccgccuaaaaauggauaaacuccgccucaaaggcguaagcuacagccuaugcaccgccgccuucacauuuaccaaaauaccagccgaaacacuccacggcaccguaacagucgaaguacaauacgccgggacggacggaccaugcaagguccccgcccagauggcagucgacaugcagacccucaccccaguagggagacuaaucacagccaacccugucauaacggaauccaccgaaaacagcaaaaugaugcuagagcuagacccgcccuucggagacuccuacaucguaauaggcgucggcgaaaagaaaauaacacaucacuggcaccgaagcggcuccaccaucgggaaagccuucgaggccacaguaagaggagcaaaacgcauggcagugcuaggcgauacagcaugggacuucggcagcguaggcggggcgcugaacucccuaggaaaaggaauacaccaaauauucggagcagccuucaagucacucuucggcggaaugagcugguucucacaaauccuaaucggcacacuccuuauguggcucggccucaacaccaaaaacgggagcauaagccucaugugccuagcacuagggggcguccuaauauuucugagcaccgcggucagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11744 - RNA, 2326 nt, Artificial Sequence
  ZIKV (strain ZikaSPH2015) prME-short variant mRNA Design 3 opt
gggagaaagcuuaccaugggacggaagcaaaacaagagaggcggcaacgaaggcaguauaauguggcucgcaagccuagcgguaguaaucgcaugugcuggagccgucaccagacgaggguccgcauacuacauguaccuagacagaaacgacgcaggagaggcaaucuccuuccccacaacacuaggcaugaauaaaugcuacauacaaauaauggaucugggacacaugugugacgccacgauguccuacgaaugcccaaugcuagacgaaggagucgaaccagacgacguagacugcuggugcaacacaacgagcacaugggucguauacgggaccugccaccacaagaagggagaagcccgccggagcaggcgcgccgugacacuaccaagucauagcacacgcaaacuccaaacccgaucacaaaccuggcuagaaagccgugaauacaccaaacaccucauccgaguggagaauuggaucuuucgaaacccaggauucgcccuagccgcagccgcgauagcauggcuauugggcagcuccaccucccaaaaagugauauaccuagucaugauacuacuaaucgccccagcauacucgauucgguguaucggggugagcaaccgcgacuucguagaaggcaugagcggcgggacaugggucgacaucguacuagaacacggcgggugcguaaccguaauggcccaagacaaacccacagucgacauagaauuaguaacgaccaccgucagcaacauggcagaaguaaggucauacugcuacgaagccucuaucuccgacauggccagcgacagcagaugccccacccaaggagaggcauaccuagacaaacagagcgacacgcaauacgucugcaaaagaacacucguagaccgcggauggggcaacggaugcggacuguucggcaaaggcucccugguaaccugcgccaaauucgcaugcagcaagaaaaugacaggaaaaagcauacaacccgaaaaccuugaguacagaauaaugcucagcguccacggaagccaacacagcggcaugauagucaacgacacaggacacgaaaccgacgaaaaccgagcaaaagucgaaaucaccccgaacucaccacgugccgaagcaacacugggaggcuucggaucacuaggcuuagacugcgaaccacgcacaggacuugacuucuccgaucuguacuaccucaccaugaacaacaaacacuggcuagugcacaaagagugguuccacgacaucccccuccccuggcacgcgggagcagacaccggcacaccccacuggaacaacaaagaagcacugguugaguucaaggacgcacacgccaaacgccaaaccguaguggugcucggcucccaggaaggagccguacacacggcacucgccggugcacuagaagcagaaauggacggagccaaaggccgcuuaagcucuggccaccuaaaguguagacugaagauggacaaacuccgccucaaaggagucagcuacucacucugcacagcagccuucaccuucaccaaaauccccgcagaaacacuacacgggacagucaccguugaaguacaauacgcaggcaccgacggacccugcaaaguccccgcacaaauggcaguagacaugcaaacccucacaccagucggccggcuaauaaccgccaaccccgugauaacagaaagcaccgaaaacagcaaaaugaugcuagaacucgacccgccauucggggacucauacaucguaaucggcguaggagaaaagaaaauuacacaccacuggcaccguucaggcaguacccuaggcaaagcauucucaacaacccuaaaaggcgcacaacgacuagccgcccugggugacacagcaugggacuucggaagcauagguggaguauucaacagcaucggacgggccguccaucaaguguucggcggcgcauucagaacccuguucggcggcaugucuuggaucacacaaggacuaaugggggcccuccuauuauggaugggcguaaacgcaagagacagaaguauagcccuggcauuccuugccacaggcggaguacugguauuccuggccaccaacguccacgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11745 - RNA, 2326 nt, Artificial Sequence
  ZIKV (isolate Z1106033) prME-short variant mRNA Design 3 opt
gggagaaagcuuaccaugggcagaaaacaaaacaaaaggggagggaacgagggcagcauuauguggcuggccagccucgccgucguaaucgcgugcgccggugcaguaacacgcaggggaagcgcauacuacauguaccuagaccgaaacgacgcaggagaagcaauuagcuucccuacaacgcuaggaaugaacaaaugcuacauccaaauaauggaccuaggucacaccugugacgcaaccaugagcuacgagugucccaugcucgacgaaggcguagagcccgacgacgucgacugcuggugcaacacaaccuccacauggguaguauauggcacaugucaccacaagaaaggagaggcacgcagguccagacgcgcgguaacccuaccaagccacagcacuagaaaacugcaaacaagaucccaaaccuggcuagagagcagagaauacacaaaacaccucauccgaguagaaaacuggauauuccgaaaccccggcuucgcgcuagcugccgcagccauagccuggcuacucggaucgagcacaagccagaaaguaaucuaccugguaaugauacuucuaaucgcaccggcguacuccaucaggugcauaggaguaagcaaccgagacuucgucgaaggaaugagcggaggaacauggguagacgucgugcucgaacacggcggcugcguaacaguaauggcacaagacaaacccacaguagacaucgagcuagucacaacaacuguaagcaacauggcagaaguacgcagcuacugcuaugaagccucaauaucagacauggcaagugauucccgaugcccaacacaaggcgaagcguaccuggacaaacaaucggacacacaguacguaugcaaacgcacccuggucgaccgaggcugggggaacggauguggacuauuuggcaagggcagccucgucaccugugccaaguucgcgugcagcaaaaagaugacaggcaaguccauacaaccagaaaaccucgaguaccgaauaaugcuauccguacacggcucccaacacuccggcaugaucguaaacgacaccggacacgaaacugacgaaaaccgcgcaaaaguugaaauuacaccaaacucgccacgugccgaagcaacucuaggcggguucggaucccuaggccuggacugcgagccaagaacaggacucgacuucagugacuuauacuaccuaacaaugaacaacaaacacuggcuaguccacaaagagugguuccaugacauaccccucccauggcacgcaggggccgacacuggaaccccacacuggaacaacaaggaagcccuagucgaguuuaaagacgcacacgcgaagcggcaaaccguaguaguccucggaucccaagaaggagcgguucauacagcacucgcgggagcccuggaagccgagauggacggagccaaaggccgccugagcucaggacaccuaaaaugccgccucaaaauggacaagcuccgacugaaaggaguaucauacucccugugcaccgccgccuucaccuucacaaagaucccagcagagacccuccacggcacagugaccguagaaguacaauacgcaggaaccgacggaccaugcaaaguacccgcccagauggcagucgacaugcaaacgcuuacaccggucggacgccugauaacagccaacccaguaaucacagaaucaaccgaaaacucuaaaaugaugcuagaacucgauccacccuucggcgacagcuacaucgucaucggagucggagaaaagaaaauaacccaccacuggcaccgauccggauccacauuagggaaagcauucagcacuacacucaaaggcgcccaacgacucgcagcauuaggagacaccgcgugggacuucggcagcauaggaggagucuucaacucaaucgggcgggcaguccaccaaguguucgggggcgcauucaggacacuauucggcggcaugaguuggaucacacaaggacucaugggagcgcuccuccucuggaugggagucaacgcuagagaccgcagcauagcccucgcauuccucgcuaccggcggcgugcucguguuccuagccacgaacguacacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11746 - RNA, 2314 nt, Artificial Sequence
  ZIKV (strain MR 766) prME-short variant mRNA Design 3 opt
gggagaaagcuuaccaugggcagaaaacaaaacaaacgcgggggcaacgagggcucgauuauguggcucgcaucacucgcagucgugauagcgugcgcaggagcgauaacgaggagaggaagcgccuacuacauguaccuggacagaagcgacgcagguaaagcaaucucguucgcaacaacacuagggguaaacaaaugccacguccaaauuauggaccuaggccacaugugcgaugcgacgauguccuacgagugcccgaugcuagacgaaggcguggaaccagacgacguagacugcuggugcaacacaacgagcacauggguggucuacggaacaugccaucacaagaaaggcgaagcccgcaggagcaggcgagcggucacucucccaagccacagcacgcggaaacuacaaacaagaagccagacauggcuugaaagccgcgaauacacaaaacaccugaucaaagucgagaacuggauauuccgaaaccccggguucgcacucguagcaguagcaauagcauggcuacuaggcucgaguaccagccagaaaguaauauaccucgugaugauacuacugaucgcgcccgccuacagcauccgcugcauaggcgucagcaacagagauuucguagaaggaaugucaggaggaacaugggucgacgucguacuagagcacggaggcugcguaacgguuauggcccaggacaaaccaacggucgacaucgaacucgugacaacaacagucagcaacauggcggaagugcgaucauacuguuacgaagcaagcauaucagacauggcaucagacucaagaugcccuacucaaggagaggcuuaccuagacaaacaaagcgacacccaguacgucuguaaaagaacauuagucgaccgaggauggggaaacgggugcggacucuucggaaaaggcucacucguaacgugcgccaaauucacaugcuccaaaaagaugacgggaaagagcauacagccagaaaaucuagaguacagaaucaugcugucaguacauggcucgcagcacagcggaaugauaggcuacgaaacggaugaagacagagccaaagucgaagucacgcccaacagcccgagagcagaagcgacccuaggcggguucggaagccugggccuagacugcgaaccgcguacgggacuggacuuuagcgaccuauacuaccucacaaugaacaauaaacacuggcuaguccauaaagaaugguuccacgacaucccgcuaccauggcaugccggggcagacacaggaacaccccacuggaacaauaaagaggcccuaguagaguucaaagacgcgcacgcaaaacgccagaccgucgugguccugggaucacaagaaggagcgguccacacagcucucgcaggagcacucgaagcagaaauggacggcgcgaaaggccgacucuucagcggccaccuuaagugcaggcucaaaauggacaaacuacgacugaaaggggucucauacagccucugcacagcagccuuuacguucacaaaaguaccagccgaaacacugcacgggaccgugacaguggaagugcaauacgccgguacagacggacccugcaaaaucccaguccaaauggcgguggauaugcaaacccuaacuccggucggccgacuaauaacggcaaauccagugaucacagaaucaaccgaaaacucaaaaaugaugcuagaacuagacccgccauucggcgacagcuacauaguaaucggggucggggacaagaaaauaacgcaucacuggcacagaagcgggagcacacucggcaaggcuuucagcacaacacuaaaaggcgcgcaaagacuugcagcacucggcgauaccgcgugggacuucgggaguauaggaggagucuucaacucaauaggacgcgcaguccaccaaguauucggaggagcauucagaacccucuucggcggcauguccuggauaacccaagggcucaugggugcgcugcuucucuggaugggggucaacgcccgggacagaagcaucgcacuagccuuucuagcaacaggaggaguacuuguauuccucgccacaaacgugcacgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11747 - RNA, 2326 nt, Artificial Sequence
  ZIKV (strain NatalRGN) prME-short variant mRNA Design 3 opt
gggagaaagcuuaccaugggacgcaaacagaacaagagaggaggaaacgaaggcagcaucauguggcuagcaucgcuagcaguaguaaucgccugcgccggcgccgucacaagacgaggcucggcauacuacauguaccuagaccgcaacgacgccggugaagcuaucucguuccccaccacgcuaggcaugaacaaaugcuacauacaaauaauggaucucgggcacaugugcgacgccacaaugucguacgaaugccccaugcuagacgaaggagucgagccugacgauguugacugcuggugcaauaccacaagcaccugggucguauacgguaccugccaccacaagaaaggcgaagcacgcagaagccgccgggcggucacccugccgagccacagcacgcgaaaacuacaaacaagaagucagaccuggcuagaauccagggaauauaccaaacaccucaucagagucgaaaacuggaucuuccgcaaccccggauucgcgcuugcagcagcagcaauagcauggcuacucgggucaagcacgagccaaaaagucaucuaccucguaaugauacuacucaucgcaccagccuacagcauaagaugcauaggagucagcaacagagacuucguagaaggcaugaguggcggcacaugggucgacgucguacuggaacacgggggcugcgucaccguaauggcacaagacaaaccaaccgucgacaucgaacucguaacaacgacagugagcaacauggcagaaguaagaucauacugcuacgaagccucaauauccgacauggccagcgacucaagaugccccacacaaggagaagcauaccuagacaaacaaucggacacccaauaugucugcaaaaggacccuagucgacagaggauggggcaacggcugcggccucuucggcaaaggaucacucguaaccugcgcaaaauucgcaugcucaaagaaaaugacgggcaaaagcauccagcccgaaaaccucgaauacagaaucaugcucagcguacacggcagccaacacagcggaaugauagugaacgacacaggacacgagaccgacgaaaaccgcgcaaaagucgagaucacaccaaacagcccacgagccgaagccacacuaggaggcuucggaagccuaggauuagacugugaaccccguaccggccuggacuucagcgaccucuauuaccucacgaugaauaacaaacacuggcugguacacaaagagugguuccaugacauaccacugccuuggcacgccggagccgacaccggcacaccccacuggaacaacaaagaggcccugguggaguucaaagacgcgcacgccaaacgacaaacagucguggucuugggaucacaagaaggcgccguacauacagcacuagcgggagcccuagaagccgaaauggacggcgcaaaaggacgccuaagcaguggacaccuuaaaugccggcuaaaaauggacaaacuaagacugaaaggaguaagcuacucacuauguacagcagcauucacauuuacaaagaucccagccgaaacacugcacggaacuguaacagucgaaguccaauacgcaggcacagacggaccauguaaaguacccgcccaaauggcaguggauaugcagacccuaacccccguagggcgauuaaucaccgcuaaccccguaauaaccgaguccacagaaaacagcaaaaugauguuagaacucgacccacccuucggagacagcuacaucgucauaggagucggagaaaagaaaauaacacaccacuggcaccggagcggaagcacacucggaaaagcauucucaaccacgcuaaaaggcgcgcaacgacuagcggcgcucggcgacaccgccugggacuucgggagcauaggcggagucuucaacagcaucgggcgagccgugcaccaggucuucggaggagcauuccggacccuuuucggaggcaugucauggaucacacaaggccuaaugggagcacuccuccucuggaugggaguuaacgcaagagaccggagcauugcccucgcguuucuagccacagggggcguccuaguauuccuagccacaaacguacaugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11748 - RNA, 2299 nt, Artificial Sequence
  ZIKV (strain ZikaSPH2015) prME-short variant mRNA Design 3 opt
gggagaaagcuuaccaugaacgaaggcucuauaauguggcuugcaucgcucgccguuguaauagcaugcgcaggcgccguaaccagacgcggaagcgcguacuacauguaccuggaccgaaacgacgccggagaagccaucuccuuccccacaacacucggcaugaacaaaugcuacauacaaauaauggaccucggacacaugugcgacgccacgaugucauacgagugccccaugcucgacgaaggagucgaaccagacgacgucgacugcuggugcaacaccaccucgaccugggucgucuacggaaccugccaccacaagaaaggagaagcccgacgaagucgcagagccguaacacuccccucccacagcacacgaaaacuccaaacaaggucacaaaccuggcucgaaucccgugaauacaccaaacaccuaauccgagucgaaaacuggaucuucagaaaccccggauucgcacuagcagcagccgcaaucgcguggcuccucggcucauccaccucccagaaagucauauaccucgucaugauacuacuaauugcaccggcguacuccauacgcugcauaggcguaagcaaccgggacuucgucgaaggaauguccggaggcacguggguggauauaguccucgagcacggaggcugcgucacagugauggcacaagacaaaccaaccgucgacauagaacucgucacaaccacaguuagcaacauggcggaaguccgaagcuacugcuacgaagcaagcauaucggacauggcgucagacucacggugcccgacacaaggggaagccuauuuagacaaacaauccgacacgcaguacgucugcaaaagaacgcuagucgacagaggauggggcaacggauguggccucuucggaaaaggcagccuaguuacaugcgcaaaauucgcaugcucaaagaaaaugacaggaaaauccauacaacccgaaaaccucgaauaccggauaaugcucucaguacacggcucacaacacagcgggaugauaguaaacgacacaggacacgaaacagacgagaacagagcuaaagucgaaaucacaccaaacucgccacgcgcagaagcgacccuuggaggauucggcagccuaggccucgacugugaacccagaacaggccuagacuuuuccgaccucuacuaccucacuaugaacaauaaacacuggcuaguccacaaagaaugguuccacgacauaccccuacccuggcacgccggggccgacacaggaacaccccacuggaacaacaaagaagcacucguggaguucaaagaugcacacgccaaaagacaaacggucgucguacugggaucacaagaaggagcagugcacacagcgcuagcaggagcacuggaagccgaaauggacggcgcaaaaggccgccuaagcuccggacaccucaaaugccgacuaaagauggacaaacuacgacucaaaggaguauccuacucacuaugcacagcggcguucacauucaccaagauucccgccgaaacccuacacggaaccgugaccguagagguccaauacgcuggcaccgacggaccgugcaaaguaccagcacaaauggccguagacaugcaaacgcucacacccgucggccgccuaaucaccgcaaaccccguaauuaccgaaucaacagaaaacuccaaaaugaugcucgaacuagauccacccuucggagacuccuacaucguaaucggugucggugaaaagaaaaucacccaccacuggcacaggucaggauccacccucgggaaagcauucagcaccacacuaaaaggcgcucaacgccuagccgcccuuggugacacugcuugggacuucggcaguauaggcggcgucuucaacagcaucggacgcgccguccaucaaguauucgggggcgcauucaggacccuauucggaggaauguccuggaucacgcaaggccucaugggggcccuccuccuauggaugggagucaacgcccgcgaccgaagcaucgcccucgccuuccucgcaaccggaggcgugcucguguuccuggccacaaacguacacgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11749 - RNA, 2299 nt, Artificial Sequence
  ZIKV (isolate Z1106033) prME-short variant mRNA Design 3 opt
gggagaaagcuuaccaugaacgaaggcagcauaaugugguuagcaucccuagccguagugauagccugcgccggcgccgucacacgaagaggaucagccuacuacauguaccuugacagaaacgacgcaggagaagcaaucucauuccccaccacccucgggaugaacaaaugcuacauacaaaucauggaccuaggccauaccugcgacgcuaccaugagcuacgaaugccccaugcucgacgaaggcgucgaacccgacgacgucgacugcuggugcaacaccaccuccacuugggucguauacggaaccugccaccacaagaaaggcgaagcacgccgaucccgccgagcugucacacuacccagccacagcacgcgcaaacuccaaacacgaagccaaaccuggcuggaaucccgggaauacacaaaacaccugauccgagucgagaacuggauauuccguaaccccggcuucgcccuugccgcagccgccaucgccuggcuccuagggagcuccacgagccaaaaagucauauaccucgucaugauccuccuaaucgcacccgccuacagcauaagaugcauaggcgucucaaaccgagacuucguagaaggcaugucaggcggcaccugggucgacgucguccuagaacacggagguugcguaacggucauggcacaagacaaaccaaccgucgacauagaacucgucaccaccacaguaagcaacauggccgaaguacgauccuacugcuacgaagcauccauauccgacauggcaagcgacucacgcugccccacacaaggggaagcauaccuugacaaacaguccgacacccaguauguaugcaaacggacccuaguagaccguggcuggggaaacggcugcggccucuucggcaaaggaucacucgucacaugcgcaaaauuugcgugcuccaagaaaaugacaggcaaaaguauacagccugaaaaccuagaauaccgcauaaugcuaagcguccacggcagccaacacuccggcaugauuguaaacgacaccggccacgagacagacgaaaaccgcgccaaagucgaaauuacccccaauucaccaagagcagaagcaacccuaggcggcuucgggagccucggacuagacugcgaaccacggaccggucucgacuuuagcgaccuauacuaccugacuaugaacaacaaacacuggcucguacacaaagaaugguuccacgacauaccccucccauggcacgccggcgccgauaccggcacaccccacuggaacaacaaagaagcgcuaguugaguucaaagacgcacacgcaaaacgacaaaccguaguaguccucggcucgcaagaaggggccguccauaccgcccucgcuggagcccucgaagccgaaauggacggagcaaaaggccgccucagcuccggccaccucaaaugcaggcucaaaauggacaaauuaagacucaaaggcgugucauacagccuaugcaccgccgccuucaccuucacaaaaauaccggcagaaacccuacacggcacagucacaguagaaguccaguacgcaggaacagacggccccuguaaagucccagcgcaaauggcaguugacaugcaaacccucacccccgucggcagacucaucacagcgaacccagucaucacagaaucaacagaaaacaguaaaaugaugcuagaacuugacccacccuucggggacagcuacauagucaucggcguaggggaaaagaaaauaacacaccacuggcaccgcucagguagcacacuaggcaaagccuucucaacaacccuaaaaggcgcacaacgcuuagccgcccuuggcgacaccgccugggacuucgguagcaucgguggaguauucaacuccaucgggcgagcgguacaccaggucuucggaggugcguuccggacccuauucgggggcaugucauggaucacccaagggcuaaugggagcucuccuccuauggaugggcguaaacgcacgagaccgguccauagcacucgccuuccuagcaaccgguggcguucuaguguuccuagccaccaacguacacgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11750 - RNA, 2287 nt, Artificial Sequence
  ZIKV (strain MR 766) prME-short variant mRNA Design 3 opt
gggagaaagcuuaccaugaacgaaggaucaaucauguggcuagccucccuagccgucguaaucgcaugcgcaggagcaauaacuagacggggaucagcauacuacauguaccucgaccgcagcgacgccgggaaagcaauauccuucgcaaccacacucggagucaacaaaugccacguccagauaauggaccucggacacaugugcgacgccacaaugucguacgaaugccccaugcuagacgaaggaguagaacccgacgacgucgacugcuggugcaacaccacaagcacauggguggucuacggcacuugucaccacaagaaaggcgaagcacgacggagccgcagagccgucacccucccaagccacagcaccagaaaacuacaaacccgcagucaaacauggcuagaaaguagggaauacacaaagcaccugaucaaaguagaaaacuggauuuuccgcaaccccggcuucgcgcucguagccgucgcgauugcauggcuccuaggcuccucaaccucccaaaaaguaauauaccuaguaaugauucuccucaucgcccccgccuacuccauccgcugcauaggcguaagcaaccgcgacuucguagagggaaugaguggcggaaccugggucgaugucguacuagaacacggaggaugcguaacaguaauggcccaagacaaacccacgguagauauagaacucguaacuaccaccguauccaacauggcagagguccgcucuuacugcuacgaagccuccaucucagacauggcaagcgacagccgcugccccacccaaggcgaagcguaccucgauaagcaauccgacacccaauacgucugcaagagaacccucguagacaggggaugggguaacggaugcggacuauucggaaagggcagccuaguaaccugcgcaaaauucacaugcuccaaaaagaugaccggcaaaucaauccaacccgaaaaucucgaauacagaauaaugcuaucaguccacggaucgcaacacuccgggaugauuggcuacgaaacagacgaagaccgggccaaggucgaaguuacgccuaacagcccccgcgcggaagcaacccuaggcggguucggaagucuaggccuggacugcgaaccgcgaaccggccucgacuucagcgaccuguauuaccucacaaugaauaacaaacacuggcucguccauaaagagugguuccacgacaucccccucccauggcacgcaggggccgacaccggcaccccacacuggaacaacaaagaagcccucguagaguucaaagacgcccacgccaaaaggcagacugucgucguacuaggcagccaagaaggcgcaguccacaccgcccuagcaggcgcacuggaagcagaaauggauggagcaaaaggacgccucuucaguggacaccucaagugccgacuaaagauggacaaacuucgacuaaaaggcgucucguacucacucugcaccgcagccuucaccuucacaaaaguaccggcagaaacacugcacgggacaguaaccgucgaaguccaauacgccggaacagacggcccaugcaagauucccguacaaauggcagucgacaugcagacccugacccccgucgggcgccuaaucacagcaaacccagugaucacagaaucaaccgaaaacuccaaaaugaugcuagaacuugaucccccauucggcgacuccuacaucgucauaggcguaggcgacaagaaaaucacccaccacuggcacagaagcggaagcacacucggcaaggcauuuucaaccacucuaaagggagcccaacgccuagcagcccuaggagacaccgcaugggacuucggaagcaucgguggcguuuuuaauucaauuggacgcgcaguucaccaggucuucggaggcgcauuccgaacacuauuuggaggaaugagcuggaucacccaagggcucaugggcgcgcuccuacuauggaugggagucaacgcacgcgacagauccauagcccucgccuuccucgcaacagggggagugcucguauuccucgcaaccaacgugcacgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11751 - RNA, 2299 nt, Artificial Sequence
  ZIKV (strain NatalRGN) prME-short variant mRNA Design 3 opt
gggagaaagcuuaccaugaacgaaggauccaucauguggcucgcgucacuagccguaguaaucgcgugugccggagccguaacccgaagaggcucggcauacuacauguaccucgaccgaaacgacgcgggugaagcaaucuccuuccccaccacacucgggaugaacaagugcuacauacaaauaauggaccucggacacaugugcgacgcaacaauguccuacgaaugcccaaugcuggacgaaggcguggaaccagacgacgucgacugcuggugcaacacaacaagcacaugggugguuuacgggaccugccaccacaagaaaggcgaagcacgccgaucccgcagagcagucacacucccgagccacagcacacgcaaacuacaaaccagaagccagacaugguuagaaagccgagaauacacaaaacaucuuauccgaguagaaaacuggaucuuccgcaaucccggguucgcacucgccgccgcagccaucgcauggcuccugggcucaagcacaucccaaaaaguaaucuaucuagugaugauccuccugauagcccccgccuacucaauacgcugcauaggaguuagcaaccgcgacuucguggaaggaauguccggcggcacaugggucgacgucguccuagaacacggcggauguguaaccgucauggcgcaagacaaacccacggucgacauugagcuaguuacgacaacaguaagcaauauggcagaaguccgauccuacugcuacgaagccucaauaagcgacauggccucagacucgcgcugccccacccaaggagaagccuaccucgacaaacaaucugacacccaauacgucugcaaacgaacccuagucgacagaggguggggaaacggaugcggccuuuucggaaaaggcagccucgugaccugcgccaaauucgcgugcucgaagaaaaugaccggcaaaagcauacaaccagaaaaccuagaauauagaaucaugcucuccguccauggcucacaacacagcggcaugauaguaaacgacacaggccacgaaaccgacgaaaaccgagccaaaguagaaauaacacccaauucccccagagcagaagcuacacuagguggcuucgggucccugggacucgacugcgaaccacgaaccggacuagacuucagcgaccucuauuaccuaaccaugaacaacaaacacuggcuaguccacaaagaaugguuucacgacauaccgcuaccauggcacgccggagcugacacagggacaccacacuggaacaacaaagaggcccugguagaguucaaagacgcgcacgcgaaacggcaaacagucguaguccugggcucccaggaaggcgcgguccacaccgcucucgccggcgcccuagaagccgaaauggacggcgccaaaggaagacugagcagcgggcaccugaaaugcagacucaaaauggacaaacugcgccuaaaaggagucuccuacagccucugcacagccgcauucaccuucacaaaaauccccgcagaaacccuacacgggacaguaaccguugaaguacaauacgcagggaccgacggaccaugcaagguaccggcacagauggcagucgacaugcaaacacuaaccccagucggccgccuaauaaccgcaaacccaguaauaacagaauccacagagaacucaaaaaugauguuagaacucgaucccccauucggcgacagcuacauagucauuggcgucggagagaaaaagauaacccaccacuggcacagaagcggauccacccuaggcaaggcauucucaaccacccuaaaaggcgcccaaagacuugcagcacucggcgacacagcgugggacuucggaagcauaggaggagucuucaacucaauagggagagcgguccaccaagucuucggcggagcguucagaacccuauucggcggcaugucauggauaacgcaaggacuaaugggcgcccuacuacuauggaugggcgucaacgccagggacaggagcauagcacuggcauuccuagccaccggcgggguccucguguuccuggccaccaacgugcacgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11752 - RNA, 2326 nt, Artificial Sequence
  ZIKV (strain ZikaSPH2015) ME variant mRNA Design 3 opt
gggagaaagcuuaccaugggcagaaaacaaaacaaacgcggcggcaacgagggcucgauaauguggcuggccucauuagcaguagucauagccugcgccggagccgucacccgccgagggagcgcauacuacauguaccuagaccgcaacgacgccggagaagccauauccuuccccacuacacucggaaugaacaaaugcuacauccaaauaauggaccucggccacaugugcgacgccacgauguccuacgagugccccaugcucgacgaaggggucgaaccagacgacguagacugcuggugcaauaccacaucaaccuggguagucuacggaacuugccaccacaagaaaggcgaagcucgccgcagccgccgagccguaacccuaccaucccacagcacgcggaaacuacagacccgaagccaaacauggcucgaaagccgcgaauacacgaaacaccuaauaagagucgagaacuggaucuuccgaaaccccggauucgcccucgccgcagccgcaaucgcguggcuacucggcuccucgacgucccagaaaguaaucuaccuagugaugauacuacucauagccccagccuacucaauccgaugcaucggggucagcaaccgggacuucguagaagggaugagcggcggaaccuggguagacauaguccuagaacacggcgggugcgugacagucauggcccaagacaaaccgacaguagacauagagcuagucaccaccacgguaaguaacauggccgaaguccgcagcuacuguuacgaagcaagcaucucagauauggccagcgacucaagaugcccaacacaaggggaagcauaccucgacaaacaaagcgacacacaguacgucuguaaacgcacccuaguagaucgaggauggggcaacggcugcggacuauucgggaaaggcagccucguaaccugcgccaaauucgccugcuccaagaaaaugaccgggaaaucgauacaaccagaaaaccucgaauaccgcauaaugcugaguguacacggcagccagcacagcgggaugauagugaacgacacaggccacgaaacggacgaaaaccgcgcuaaaguagaaaucaccccaaacucaccccgagcugaagcuacccuagggggcuucggcagucugggacuagacugcgaacccagaaccggccuugacuucagcgaccucuacuaccuuaccaugaacaacaaacacuggcucguccacaaagagugguuccacgacaucccccucccauggcaugccggagcagacacgggcacaccccacuggaacaauaaggaagcccucguagaguucaaagacgcccacgccaaacgccaaaccguaguaguccucggcucccaagaaggagcaguucacacagcacucgcgggcgcccucgaagcagaaauggacggcgccaaaggccgccucagcagcggacaccuaaagugccgacuaaaaauggacaagcuacgccucaaaggggucuccuacagccucugcacggccgccuucaccuucacaaaaauaccagcggaaacacuccacggcacaguaaccgucgagguacaauacgccggcaccgacggccccugcaaaguaccagcccaaauggccgucgacaugcaaacccucacacccgucggacgacuaauaaccgcuaacccagucauuacagaauccaccgaaaacaguaagaugaugcucgagcucgacccgcccuucggcgacucauacaucguaauaggcgucggcgagaagaagauaacccaccacuggcaccgcucaggaagcaccauaggcaaagccuucgaagcgacaguacgaggcgcaaaaagaauggcgguccuaggagauaccgccugggacuucggcucagucggaggagcacuaaacagccuaggcaaaggaauccaccaaaucuucggugccgccuucaagucgcuauucggaggcauguccugguucagucaaauccucaucggcaccuuauuaauguggcuaggacugaacacuaaaaacggaaguaucagccucaugugucuagcccucggcggaguacuaaucuuccucucgacagccgucuccgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11753 - RNA, 2326 nt, Artificial Sequence
  ZIKV (isolate Z1106033) ME variant mRNA Design 3 opt
gggagaaagcuuaccaugggacgaaagcaaaacaagcgcggagggaacgaaggauccaucaugugguuagccucacucgcaguagucauagccugcgccggcgccgucacaagaagaggauccgccuacuacauguaccuugaccgaaacgacgcaggcgaagccaucuccuuccccacaacccuggggaugaacaaaugcuacauacaaauaauggaccucggccauaccugcgacgcaaccaugagcuacgaaugcccaaugcuagaugaaggcguagaacccgacgacguugacugcuggugcaacacaaccuccacguggguuguauacggaaccugccaccacaagaaaggcgaggcacgccgcagccgacgagcagucacacuacccagccacaguacaagaaaacuccaaacgcgaagccaaacauggcucgagagcagagaauacaccaaacaccucaucaggguagagaacuggauauucagaaaccccgguuucgcccucgcagcugcagccauagccuggcucuugggcucauccaccagccaaaaaguaaucuaccuggugaugauauuacucaucgcccccgcguacucgaucagaugcaucgguguuuccaaccgagacuucgucgaagggaugagcggcggaaccuggguagacguaguccucgaacacggaggaugcgucacaguaauggcccaagacaaacccacagucgacauagagcuaguuaccaccaccguaaguaauauggcagaagugcgcucauacugcuacgaagcaucaaucucugacauggccucugacucccgaugccccacacagggagaggccuaccuagacaaacaauccgacacccaauacguaugcaaacgaacacucgucgaccgcggcuggggcaacgggugcggacuauucggaaaaggaucacucguaaccugcgccaaauucgccugcucaaagaaaaugacaggcaaaagcauccaacccgaaaaccucgaauaccgcaucaugcucuccguccacggaucccagcacuccggcaugauagucaacgacaccggacacgagacagacgaaaaccgcgcaaaagucgaaaucacaccaaacagcccccgagcagaagcaacacucggaggcuucgguucccucggccuugacugcgaacccagaacaggccuagauuucagcgaccucuacuaucucaccaugaacaacaaacacuggcucguccauaaagagugguuccacgacaucccccuacccuggcacgccggagccgauaccggcaccccacacuggaacaacaaagaagcccucgucgaguucaaagacgcgcacgcgaaaagacaaaccgucgucguccugggcucccaagaaggggcaguccacacugcccucgccggugcacuagaagcagaaauggacggcgcaaagggccgacugaguagcggucaccugaaaugcagacucaaaauggacaaacuccgacucaaaggagucucauacucacuaugcaccgccgcguucacauuuacaaaaauacccgcggaaacgcugcacggcacagugaccguagaaguacaauacgccggcaccgacggaccaugcaaagucccagcccaaauggcagucgacaugcaaacucucaccccaguuggccgacuaauaacagcaaacccuguaauaacagaaucaacagagaacuccaaaaugaugcucgaacucgacccgcccuucggagacagcuacauagucaucggggucggcgagaaaaagauuacccaccacuggcacaggagcgggagcaccaucggcaaagcauucgaagccacagucagaggcgcgaaacgcauggccguccuuggcgacacagcaugggauuucggaagcguaggcggggcauuaaacucacucggaaaaggcauacaccagaucuucggagccgccuucaaaagccuauucgggggcaugaguugguucucccaaauacuuaucggaacacuacucauguggcuaggccucaacgccaaaaacgguucuauaucacuaaugugccuagcccucggcggcguccuaaucuuccucagcacggccgucucagccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11754 - RNA, 2314 nt, Artificial Sequence
  ZIKV (strain MR 766) ME variant mRNA Design 3 opt
gggagaaagcuuaccaugggucgcaaacaaaacaaacgaggcgggaacgaaggcagcauaauguggcucgccucccucgcagucgucauugccugcgcgggggcaauaacacggagaggaucggccuacuacauguaccuagaccgcagcgaugcaggaaaagcgaucagcuucgcgaccacgcuaggcgucaacaaaugccacguacaaaucauggaccucggacacaugugcgacgcaacaaugucauacgaaugccccaugcuagacgaaggaguagaaccagacgacguagacugcuggugcaacaccacgagcacaugggucguauacggcacaugccaccacaagaaaggggaagcgcgccgcagccgacgcgcagucacacuuccaagccacagcacacgcaagcuccaaacccgaagccagacauggcucgaaagccgggaauacaccaaacaccugaucaaaguagagaacuggaucuuccgaaaucccggcuucgcccucguagccguggccaucgcguggcuccugggaucgagcacaagccaaaaaguaaucuaccugguaaugauacuccuaaucgcucccgcauacucaaucagaugcaucggcguaagcaaucgcgacuucgucgaaggcaugagcgggggaaccuggguagacgucguacucgagcacggcggcugugucaccgugauggcccaggacaagccaacagucgacaucgagcuaguaaccacaaccguguccaacauggcagaaguacgaucauacugcuacgaggcauccaucucagacauggcaucagacucgcgcugucccacacaaggcgaagcguaccuagacaaacaaucagacacccaguacguaugcaaacgaacccuagucgaccgcggauggggcaacggaugugggcuauuuggcaaaggcucacucgugaccugcgcaaaauucacaugcagcaagaaaaugaccggaaaaagcauccaaccggaaaaccucgaauaccggauaaugcugucgguccacgggagucagcacagcggcaugauaggauacgaaacagacgaggacagagcaaaagucgaagucacaccaaacuccccgcgggcagaggccacccuggguggcuucggcagccuaggacuggacugcgaaccacgcacaggccuagacuucuccgaccuauacuaccuaacaaugaacaacaaacacuggcuagugcacaaagaaugguuccacgacaucccccuccccuggcacgcaggcgcagauaccggaacaccacacuggaacaacaaggaggcccuaguagaguucaaagacgcacacgccaaacgacaaacuguaguaguccugggaucccaagaaggugcgguacauacagcccucgcaggcgcacuggaagcagaaauggacggagcaaaagggcgccucuucuccggccaccuaaagugccgccuuaaaauggacaaacugagacugaaaggugucagcuacagucuaugcaccgccgccuucaccuucaccaaaguccccgccgaaacccugcacggaaccguaacagucgaaguacaauacgccggcaccgacggaccgugcaaaauaccaguccaaauggcgguugacaugcaaacucuaacccccgucgggcgccuaauaacagcaaauccggucaucacggaaucaaccgaaaauucaaagaugaugcuugaacuagacccacccuucggcgacagcuacauagucauaggagucggagacaagaaaauaacccaccacuggcaccgaucgggcuccacaaucggaaaagccuucgaagccacgguaagaggagcaaaacgaauggccguacuuggggacacagcgugggacuucgggagcgucggaggagucuucaacucacuagggaagggaauccaccaaauauucggagccgcguucaaaucacuguucggaggaaugagcugguucucccaaauacuuaucggcacacuccucgucuggcucggacuaaacaccaaaaacggcagcauaagccugacaugucucgcguuaggcggaguaaugauauuccucuccacagccgucagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11755 - RNA, 2326 nt, Artificial Sequence
  ZIKV (strain NatalRGN) ME variant mRNA Design 3 opt
gggagaaagcuuaccaugggccgaaaacaaaacaaaagaggaggcaacgaaggcagcaucaugugguuagccucccuggccguagucaucgccugcgcaggcgccguaacccgccgcggcucagcauauuacauguaccuggaccgaaaugacgccggcgaagccauauccuucccaacgacacuaggaaugaacaaaugcuacauccaaaucauggaccucggccacaugugcgacgcaacaauguccuaugaaugcccaaugcuggacgaaggcguagaacccgacgacguagacugcugguguaacaccaccaguacaugggugguauacggcacaugccaccacaagaaaggcgaagcgcgcagauccaggcgcgcagucaccuuaccuagccacagcaccagaaaacuacaaacccgaagucaaaccuggcuagaauccagagaauacaccaaacaccugauccgcgucgagaauuggaucuuccgcaaccccggauucgcacucgcagccgcagcaaucgcauggcuacuggggucuuccacaucgcaaaaggugaucuaccugguaaugauccuccucauagcucccgcguacucaaucaggugcaucggaguauccaacagagacuucguagaaggaauguccggcgggaccugggucgauguaguacuugaacacggggguugcguaacggucauggcacaagacaaaccaaccguagacauagagcucgucacaaccacagucagcaacauggcggaaguucgaucauacuguuacgaagccagcauaucagacauggccucggacagccgaugcccaacacaaggagaggcauaccucgacaaacagagcgacacacaauacguaugcaaacgcaccuuggucgaccgcggcuggggaaacggaugcggacucuucggaaaaggcucccuaguaaccugcgccaaauucgcuugcucaaagaaaaugaccggaaaaagcauacaaccagaaaaccuugaauaccgaauaaugcucucgguccacggcucacaacacagcggaaugauagucaacgacacgggccacgaaaccgaugagaacagagccaaagucgagaucacaccaaacagcccccgagcagaggcaacacucggcggguucgguagccuaggacuagacugcgaaccacgaaccggcuuagacuucagcgaccuuuacuaucuaaccaugaacaacaaacacuggcucguccacaaagaaugguuccacgacaucccacuccccuggcacgcaggagccgacaccggcacuccccacuggaacaacaaagaagcccuagucgaguucaaagacgcacacgcaaaacgccaaaccgucgucguacugggcucacaggaaggagccguacacaccgcacuagccggagcgcucgaagcagaaauggacggcgcaaagggcagacuaucaagcggccaccugaaaugcaggcuaaaaauggacaaacuccgacucaaaggagucuccuacagccucugcacagcugccuucacauucaccaagaucccagccgaaacccugcacggaacagucaccgucgaaguacaguacgccggaaccgacggccccugcaagguacccgcccaaauggccgucgacaugcagacccugacaccaguaggacgacucauaacugcaaauccaguaaucaccgaaucaaccgaaaacucgaagaugaugcuggaacucgaucccccauucggcgacuccuacaucgucauaggggucggcgagaaaaagauaacccaccacuggcaccgcagcggcagcaccauaggaaaagcguucgaagcaaccguaagaggagcuaaaagaauggcagugcugggcgacacagccugggacuucggcucagugggaggcgccuuaaacucgcucggaaaaggcauccaccagauauucggagcagcauucaagagccucuucggcggaaugaguugguucucucaaauccucaucggcacccucuugauguggcucggccuaaacaccaaaaacggaagcaucucccucaugugccucgcccuaggaggcguccucauauuccuaagcacagcaguauccgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11756 - RNA, 2299 nt, Artificial Sequence
  ZIKV (strain ZikaSPH2015) ME variant mRNA Design 3 opt
gggagaaagcuuaccaugaacgaaggcuccauuauguggcuagcaucacuagcggucgucaucgccugcgccggcgccgucaccagacgcggcuccgcuuacuacauguaccuggaccgaaacgacgccggagaagcgauauccuucccaacaacacucgguaugaacaaaugcuacauccaaauaauggaccucggccacaugugcgacgcaaccaugucauacgaaugccccaugcuggacgaaggagucgaacccgacgacgucgacugcuggugcaacacaacaagcaccugggucgucuauggcacaugccaccacaagaaaggggaagcccggcgcagcaggcgcgcgguaacacuccccagccacuccacccgaaaacuccaaacccgcagucagacauggcucgaaucccgcgaauacaccaaacaccugauccgcguugaaaacuggaucuucagaaacccaggcuucgcccucgccgccgcagcaaucgccuggcuacugggcuccucgacaagucaaaaagucauuuaccuaguaaugauccuccuuauagccccagccuacucaaucagaugcaucggggucuccaaccgagacuucguagaaggaaugucgggcggaacauggguagacaucguccucgaacacggcggaugcguaaccgugauggcccaagacaaaccaacagucgacauagagcuagucacaacaacaguaucaaacauggccgaaguacgauccuacugcuacgaagccucuaucucagacauggcgucggacagccgcugcccgacacaaggcgaagccuaccuagacaagcaaucggacacccaauacgucugcaaacggacccuugucgaccguggcuggggcaacggcugcggccuauucggcaaaggaucacucguaaccugcgccaaguucgcaugcuccaagaaaaugacgggcaaaagcauccagcccgaaaaccuagaauaccgaaucaugcucucaguccacggcucacaacacagcggcaugauagucaacgacacuggacacgaaaccgacgaaaacagagccaaagucgaaaucacccccaacagccccagagcggaagcuacgcucggcggcuucgguucccucggccuagacugcgagcccagaaccggccucgacuucagcgaccucuacuaccucacaaugaacaacaaacauuggcugguccacaaagaaugguuccacgacauaccgcuaccauggcaugcaggcgccgacacuggaacgccccacuggaacaacaaagaggcacucgucgaguucaaagacgcacacgcaaaacgccaaaccgucgucguacuaggcucacaagaaggcgccguccauaccgcacucgcaggggcacuggaagccgagauggauggagccaaaggccgacucagcuccggccaccucaaaugccgacuaaaaauggacaaacuacgacuaaaaggcgucucuuacucacuauguaccgcagcauuuacauucacgaagaucccagcugaaacccuccacggaaccguaaccgucgagguccaauacgccggaaccgacggcccaugcaaggucccagcccagauggccguagacaugcaaacccuaacaccuguaggaagacuaaucaccgcaaaccccguaaucaccgaauccaccgaaaacagcaaaaugaugcucgaacuggacccacccuuuggcgacuccuacauagugauuggcgucggugagaaaaagauaacccaccacuggcacaggagcggcagcaccauaggcaaagccuucgaagcuacagucagaggagcaaaaagaauggccguccucggcgacacagccugggacuucgguuccgucggcggcgcccuaaacucgcuuggaaagggcauccaccaaauauucggcgcagcauucaaaucacuauucggcgggaugucaugguucucccaaauacucauuggcacucuccuaauguggcuaggccucaacaccaaaaacggcucuaucagccucaugugccucgcccuagguggcguacuaauauuccucucgaccgcaguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11757 - RNA, 2299 nt, Artificial Sequence
  ZIKV (isolate Z1106033) ME variant mRNA Design 3 opt
gggagaaagcuuaccaugaacgagggcucuaucauguggcuagcaucccucgccgucgucauugcaugcgcaggagcaguaacacgacggggcucggcauacuacauguaccuagacagaaacgacgccggggaggcaaucuccuuccccaccacgcucggcaugaacaaaugcuacauacaaauaauggaccuaggacauaccugcgaugcaacaauguccuacgaaugccccaugcucgacgaaggaguagaaccagacgacgucgacugcuggugcaauacgacaaguacuuggguggucuacggcacaugccaccacaagaaaggcgaagcacgcagaagccgccgcgcgguuacccucccaagccacucaacgcgaaagcuccaaacacgaagccaaacauggcuagaaucccgagaauacacaaagcaccugaucagggucgaaaacuggaucuuccgaaauccaggauucgcacucgcagccgccgcaauagcauggcuacuaggcucuagcacaagccaaaaaguaaucuaccucguaaugauucuccucaucgccccagccuacucaaucagaugcaucggcguaagcaaccgcgacuucgucgaaggaaugucaggcggaacuugggucgacguaguccuagagcacggaggcugcgugacaguaauggcccaagauaagcccacagucgauaucgaauuagucacaaccaccgucuccaauauggcagaaguacgaucguacugcuacgaagcauccauaucagacauggccuccgacucgcgcugccccacccaaggagaagcguaccuagacaaacaauccgacacgcaauacgucugcaaaagaacgcugguagaccgaggcuggggcaacggaugcggccucuucggcaaaggcucacuggucaccugugcaaaguucgccugcuccaagaaaaugacaggcaaaagcauacagccggaaaaccucgaguaccggauaaugcuauccguccacggcagccaacacucagggaugauagucaacgacaccggccacgaaacagacgaaaaccgagccaaggucgaaaucacacccaacucaccccgcgccgaagcaacccugggaggcuucggaucccucgggcucgacugcgagccccgcaccggccuagacuucagcgaccucuacuaccucacaaugaacaacaaacacuggcuaguacacaaggaaugguuccaugacauaccacuccccuggcacgcaggagcggacacaggcaccccacacuggaacaacaaggaagcccugguugaguucaaggacgcgcacgcaaaacgucaaacagucguagugcucggcucccaagaaggagccguccauaccgcccuagccggagcgcucgaggccgaaauggacggagcaaagggacgccuaagcuccggccaccuaaaaugccggcuaaaaauggacaaauuacgccuaaaaggcgucucauacucgcuaugcaccgcagccuucacauucacaaaaauccccgccgaaacacugcacggaacaguaaccgucgaaguacaauacgccggaaccgacggccccugcaaagucccggcacaaauggccgucgacaugcaaacacugacuccagucggcagacucauaaccgcaaacccaguaauaacagaauccacugaaaacucgaaaaugauguuggaauuagacccacccuucggagacagcuacauagucaucggaguaggcgaaaagaaaauaacacaccacuggcacaggagcggcucaacaaucggcaaagccuucgaggcaacugucagaggcgccaaaagaauggccguacuaggcgacaccgcaugggauuucggaaguguaggaggagcccuaaacagccuaggaaaaggcauucaccaaauauucggagccgccuucaagucccuauucggaggcaugucaugguucagccaaauacucauaggaacguuacugauguggcucggccucaacgccaaaaacggaagcaucagccucaugugccucgcgcuaggaggaguccucauauuccugagcaccgcaguaagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11758 - RNA, 2287 nt, Artificial Sequence
  ZIKV (strain MR 766) ME variant mRNA Design 3 opt
gggagaaagcuuaccaugaacgaaggcagcaucauguggcuagcaucgcuggccgucgucaucgcaugcgcaggcgcgaucacccgcaggggaucagcauacuauauguaccuagaccgcagugacgccgguaaggcaaucagcuucgccacgacacucggcguaaacaaaugucacguacaaauaauggaccucggacacaugugcgacgccaccaugaguuacgaaugccccauguuagacgaaggaguagaacccgacgacguagacugcuggugcaacaccaccuccacaugggucgucuacggaaccugccaccacaagaaaggggaagcacgccgaucacggagggcagucacccugcccagccacagcacgcgaaaacugcaaacccgaagccaaaccugguuagaaucacgagaauacaccaaacaccucaucaaaguagaaaacuggauuuuccgaaacccggguuucgcccuaguagcaguagcaaucgcaugguuacucggaagcagcaccagccaaaaagucaucuaucuaguaaugauccuacuaaucgccccggccuacuccauaagaugcaucggagucuccaacagagacuucguagaagggaugucaggcgggacaugggucgacgucguccucgagcacggagggugcgugaccgucauggcccaagacaaacccacagucgacauagaacucgucaccacgacagucagcaacauggcagaagugcgcuccuauugcuaugaagccagcauaagcgacauggccucggacucacgcugcccgacgcagggagaagccuacuuagacaaacaauccgacacccaauacgugugcaaacggacacucgucgaccgcggguggggaaacggaugcggacuguucggaaagggcagccuggucacaugcgccaaguuuaccugcagcaaaaagaugacuggaaaaagcauacagccagaaaaccucgaauaccgcaucaugcuaagcguacacgggagucaacacuccggcaugauaggauacgaaaccgacgaagaccgugccaaaguagaaguaacccccaacagcccccgcgccgaggccacccuaggaggcuucggcagccuaggacucgacugcgagccccgcaccggccuggacuucagcgaccucuacuaccucacaaugaacaacaagcacuggcuaguacacaaggaaugguuccacgacauaccgcuacccuggcacgcaggcgccgacacaggcacaccccacuggaacaacaaggaagcccugguagaguucaaagacgcccacgcaaaacgccaaacaguaguagucuugggcucgcaagaaggagccguacacacagcacuagccggagcacucgaagcagaaauggacggcgcaaaaggccgccuauucagcggccaccucaagugccgacucaaaauggacaaacuccgacuuaaaggagugucguacagccucugcaccgcggccuucaccuucaccaaaguacccgccgaaacacuacacgguacagucaccgucgaaguccaauacgcaggaacagacggaccaugcaaaauucccguccaaauggccgucgacaugcaaacccucaccccuguaggacgacucauaacagcaaacccaguaauaacugaaagcaccgaaaacagcaaaaugaugcuagaacuagacccacccuucggugacaguuauaucguaauaggagucggagacaagaaaaucacacaccacuggcaccgaucaggaucaacaauuggcaaagccuucgaagccacaguaaggggcgcgaaacgcauggccguacucggagacaccgccugggacuucggaucaguaggcggcgucuucaacucccucggaaaaggcauacaccaaauuuucggugccgcguucaagagccucuucggcggaauguccugguucagccaaauacuaaucggaacgcuccuagucuggcucggauuaaacaccaaaaacggaagcauaucccugaccugccucgcacucggaggaguuaugaucuuccucucaaccgcagucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11759 - RNA, 2299 nt, Artificial Sequence
  ZIKV (strain NatalRGN) ME variant mRNA Design 3 opt
gggagaaagcuuaccaugaacgaaggaagcauaauguggcuggcaucgcuagccguaguaauagcaugcgcaggcgcgguaacgcggcgggggucagccuacuacauguaccuagacagaaacgacgccggagaagccaucagcuuccccacaacacuaggaaugaacaaaugcuacauacaaauaauggaccuaggacacaugugcgacgcgacaauguccuacgagugcccgaugcuagacgaaggugucgaacccgacgacgucgacugcuggugcaacaccaccagcacauggguagucuacggcacaugccaccacaagaaaggagaagcacgacgcagccgccgcgcggucacccugccgagccacagcacacgaaaacugcaaacacggucacaaaccuggcuagaaagccgcgaguacacaaagcaccuuaucagaguagaaaacuggaucuuccgcaaucccggauucgcccuggcagcagccgccauagccuggcuacucggcucgagcaccagccaaaagguuaucuaccuagugaugauacuccucaucgcacccgcuuacuccauacguugcaucgggguaucaaaccgagacuucguagaaggcauguccggaggaaccugggucgacguaguucucgaacacggcgguugcgucacggucauggcucaggacaaaccaacagucgacaucgaacucgucaccacaaccgugagcaacauggccgaaguccgcaguuacugcuacgaggcaagcaucagcgacauggcaagcgacagccgaugccccacacaaggagaagcauaccuugacaaacagagcgacacccaauacgucugcaaacgaacauuggucgacagaggcuggggaaacggaugcggacuauucggaaaaggaagccuaguaaccugcgcaaaauucgccugcucaaagaaaaugaccgggaaaagcauacaacccgaaaaccuagaguaccgcauaaugcugagcguccacggcucacaacacuccggcaugauagucaacgacacgggccacgaaacagacgagaacagagccaaaguagaaaucacaccaaacagcccacgcgcagaagcaacccuaggagguuucgggagcuuaggacucgacugugaaccccgaaccggacucgacuucagcgaccuguacuaccucaccaugaacaacaaacacuggcuaguacacaaagaaugguuccacgacauaccacucccauggcacgccggggcagacacagguaccccgcacuggaacaacaaggaagcccuggucgaguucaaagacgcacacgcaaaaagacaaaccgucgugguacuaggaucacaagaaggagcgguccacacagcacucgccggagcgcuugaagcggaaauggacggagcaaaaggccgacucaguagcgggcaccuaaagugccggcuaaaaauggacaaacuccgacuaaaaggagucucauacucgcuaugcaccgccgccuucacguucacaaaaaucccagcugaaacccugcacggcaccguaaccguagagguccaauacgcaggaacugacgggccaugcaaaguacccgcacaaauggcagucgacaugcaaacacuaaccccuguaggccgccucauaacagcaaauccaguaaucaccgaaucaaccgaaaacagcaaaaugauguuagaacucgacccaccguucggcgacagcuacauagucauaggugucggcgagaaaaagaucacccaccacuggcaccgaucgggcucgaccaucggcaaagcauuugaagcuacaguacgaggcgcgaaacgaauggcgguccucggugacacagccugggacuucggaucaguaggcggggcacucaauuccuugggaaaaggaauccaccagaucuucggagcagcauucaaaucccuuuucgggggcaugagcugguucucccaaauacuaauaggcacacugcuaauguggcuaggacucaacaccaaaaacggcagcaucucccugaugugccucgcacuagguggcguacucaucuuccucuccacagcagucuccgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu
